US012454694B2

(12) United States Patent
Evans et al.

(10) Patent No.: US 12,454,694 B2
(45) Date of Patent: Oct. 28, 2025

(54) COMPOSITIONS AND METHODS FOR IMPROVING BASE EDITING

(71) Applicant: Beam Therapeutics Inc., Cambridge, MA (US)

(72) Inventors: John Evans, Cambridge, MA (US); Jason Michael Gehrke, Cambridge, MA (US)

(73) Assignee: Beam Therapeutics Inc., Cambridge, MA (US)

( * ) Notice: Subject to any disclaimer, the term of this patent is extended or adjusted under 35 U.S.C. 154(b) by 886 days.

(21) Appl. No.: 17/273,071

(22) PCT Filed: Sep. 7, 2019

(86) PCT No.: PCT/US2019/050112
§ 371 (c)(1),
(2) Date: Mar. 3, 2021

(87) PCT Pub. No.: WO2020/051562
PCT Pub. Date: Mar. 12, 2020

(65) Prior Publication Data
US 2022/0127622 A1  Apr. 28, 2022

Related U.S. Application Data

(60) Provisional application No. 62/728,698, filed on Sep. 7, 2018.

(51) Int. Cl.
*C12N 15/62* (2006.01)
*C12N 9/22* (2006.01)
(Continued)

(52) U.S. Cl.
CPC .............. *C12N 15/62* (2013.01); *C12N 9/22* (2013.01); *C12N 9/78* (2013.01); *C12N 15/11* (2013.01);
(Continued)

(58) Field of Classification Search
CPC . C12N 15/62; C12N 9/22; C12N 9/78; C12N 15/11; C12N 15/86; C12N 15/907;
(Continued)

(56) References Cited

U.S. PATENT DOCUMENTS 7,915,114 B2  3/2011 Hsiao et al.
9,068,179 B1  6/2015 Liu et al.
(Continued)

FOREIGN PATENT DOCUMENTS

CN  103088008 A  5/2013
CN  105934516 A  9/2016
(Continued)

OTHER PUBLICATIONS

Yan et al. Highly Efficient A T to G C Base Editing byCas9n-Guided tRNA Adenosine Deaminase in Rice. Mol Plant. Apr. 2, 2018;11(4):631-634 . . . (Year: 2018).*
(Continued)

*Primary Examiner* — Marcia S Noble
*Assistant Examiner* — Briana N Ebbinghaus
(74) *Attorney, Agent, or Firm* — Greenberg Traurig, LLP; Melissa Hunter-Ensor; Nicholas R. Ballor

(57) ABSTRACT

The invention features compositions and methods for modifying a polynucleotide (e.g., DNA) using a nucleobase editor comprising a first DNA binding protein domain that is catalytically inactive, a domain having base editing activity, and a second DNA binding protein domain having nickase activity. The invention also features a fusion protein comprising a domain having base editing activity (e.g., cytidine deaminase or adenosine deaminase), and two nucleic acid programmable DNA binding protein domains (napDNAbp), a first napDNAbp comprising nickase activity and a second napDNAbp that is catalytically inactive, where at least the two napDNAbps are joined by a linker, as well as related
(Continued)

methods for using such base editors, and kits comprising the base editors.

17 Claims, 10 Drawing Sheets

Specification includes a Sequence Listing.

(51) Int. Cl.
  *C12N 9/78* (2006.01)
  *C12N 15/11* (2006.01)
  *C12N 15/86* (2006.01)
  *C12N 15/90* (2006.01)
(52) U.S. Cl.
  CPC ............ *C12N 15/86* (2013.01); *C12N 15/907* (2013.01); *C12Y 305/04004* (2013.01); *C12Y 305/04005* (2013.01); *C07K 2319/09* (2013.01); *C07K 2319/80* (2013.01); *C12N 2310/20* (2017.05); *C12N 2710/16143* (2013.01); *C12N 2800/80* (2013.01)
(58) Field of Classification Search
  CPC ...... C12N 2310/20; C12N 2710/16143; C12N 2800/80; C12N 15/113; C12Y 305/04004; C12Y 305/04005; C07K 2319/09; C07K 2319/80; C07K 2319/00
  See application file for complete search history.

(56) References Cited

U.S. PATENT DOCUMENTS

| | | | |
|---|---|---|---|
| 9,322,037 | B2 | 4/2016 | Liu et al. |
| 9,388,430 | B2 | 7/2016 | Liu et al. |
| 9,512,446 | B1 | 12/2016 | Joung et al. |
| 9,737,604 | B2 | 8/2017 | Liu et al. |
| 9,840,699 | B2 | 12/2017 | Liu et al. |
| 10,113,163 | B2 | 10/2018 | Liu et al. |
| 10,167,457 | B2 | 1/2019 | Liu et al. |
| 10,465,176 | B2 | 11/2019 | Liu et al. |
| 10,526,401 | B2 | 1/2020 | Muir et al. |
| 10,682,410 | B2 | 6/2020 | Liu et al. |
| 10,745,677 | B2 | 8/2020 | Maianti et al. |
| 10,912,833 | B2 | 2/2021 | Liu et al. |
| 10,947,530 | B2 | 3/2021 | Liu et al. |
| 11,053,481 | B2 | 7/2021 | Liu et al. |
| 11,124,782 | B2 | 9/2021 | Liu et al. |
| 11,142,550 | B2 | 10/2021 | Muir et al. |
| 11,142,760 | B2 | 10/2021 | Slaymaker et al. |
| 11,155,803 | B2 | 10/2021 | Gaudelli et al. |
| 11,193,123 | B2 | 12/2021 | Halperin |
| 11,214,780 | B2 | 1/2022 | Liu et al. |
| 11,268,082 | B2 | 3/2022 | Liu et al. |
| 11,306,324 | B2 | 4/2022 | Liu et al. |
| 11,319,532 | B2 | 5/2022 | Liu et al. |
| 11,479,767 | B2 | 10/2022 | Smith et al. |
| 11,542,496 | B2 | 1/2023 | Liu et al. |
| 11,732,274 | B2 | 8/2023 | Liu et al. |
| 11,752,202 | B2 * | 9/2023 | Slaymaker ............... C12N 9/22 424/93.21 |
| 12,129,478 | B1 | 10/2024 | Chen et al. |
| 12,241,096 | B2 | 3/2025 | Joung et al. |
| 12,275,952 | B2 | 4/2025 | Chen |
| 12,312,613 | B2 | 5/2025 | Kleinstiver et al. |
| 2004/0003420 | A1 | 1/2004 | Kuhn et al. |
| 2004/0115184 | A1 | 6/2004 | Smith et al. |
| 2005/0222030 | A1 | 10/2005 | Allison |
| 2011/0104787 | A1 | 5/2011 | Church et al. |
| 2013/0109048 | A1 | 5/2013 | Giugliano et al. |
| 2014/0068797 | A1 | 3/2014 | Doudna et al. |
| 2014/0186958 | A1 | 7/2014 | Zhang et al. |
| 2014/0273226 | A1 | 9/2014 | Wu |
| 2014/0273230 | A1 | 9/2014 | Chen et al. |
| 2014/0356956 | A1 | 12/2014 | Church et al. |
| 2015/0071903 | A1 | 3/2015 | Liu et al. |
| 2015/0165054 | A1 | 6/2015 | Liu et al. |
| 2015/0166980 | A1 | 6/2015 | Liu et al. |
| 2015/0166982 | A1 | 6/2015 | Liu et al. |
| 2015/0166984 | A1 | 6/2015 | Liu et al. |
| 2015/0166985 | A1 | 6/2015 | Liu et al. |
| 2015/0344549 | A1 | 12/2015 | Muir et al. |
| 2016/0046961 | A1 | 2/2016 | Jinek et al. |
| 2016/0200779 | A1 | 7/2016 | Liu et al. |
| 2016/0201089 | A1 | 7/2016 | Gersbach et al. |
| 2016/0208243 | A1 | 7/2016 | Zhang et al. |
| 2016/0304846 | A1 | 10/2016 | Liu et al. |
| 2016/0355797 | A1 | 12/2016 | Konermann et al. |
| 2017/0121693 | A1 | 5/2017 | Liu et al. |
| 2017/0233703 | A1 | 8/2017 | Xie et al. |
| 2017/0247671 | A1 | 8/2017 | Yung et al. |
| 2017/0275648 | A1 | 9/2017 | Barrangou et al. |
| 2017/0327804 | A9 | 11/2017 | Joung et al. |
| 2018/0002736 | A1 | 1/2018 | O'Connell et al. |
| 2018/0073012 | A1 | 3/2018 | Liu et al. |
| 2018/0127780 | A1 | 5/2018 | Liu et al. |
| 2018/0170984 | A1 | 6/2018 | Harris et al. |
| 2018/0179503 | A1 | 6/2018 | Maianti et al. |
| 2018/0216095 | A1 | 8/2018 | Thanos et al. |
| 2018/0237787 | A1 | 8/2018 | Maianti et al. |
| 2018/0298421 | A1 | 10/2018 | Carpenter et al. |
| 2018/0312828 | A1 | 11/2018 | Liu et al. |
| 2019/0002875 | A1 | 1/2019 | Cheng et al. |
| 2019/0010471 | A1 | 1/2019 | Zhang et al. |
| 2019/0010481 | A1 | 1/2019 | Joung et al. |
| 2019/0093099 | A1 | 3/2019 | Liu et al. |
| 2019/0225955 | A1 | 7/2019 | Liu et al. |
| 2019/0367891 | A1 | 12/2019 | Liu et al. |
| 2019/0382775 | A1 | 12/2019 | Tan et al. |
| 2020/0063127 | A1 | 2/2020 | Lu et al. |
| 2020/0190493 | A1 | 6/2020 | Liu et al. |
| 2020/0308571 | A1 | 10/2020 | Joung et al. |
| 2020/0399619 | A1 | 12/2020 | Maianti et al. |
| 2021/0130800 | A1 | 5/2021 | Zhang |
| 2021/0198330 | A1 | 7/2021 | Liu et al. |
| 2021/0252118 | A1 | 8/2021 | Slaymaker et al. |
| 2021/0277379 | A1 | 9/2021 | Gaudelli et al. |
| 2021/0317440 | A1 | 10/2021 | Liu et al. |
| 2021/0371858 | A1 | 12/2021 | Evans |
| 2021/0380955 | A1 | 12/2021 | Bryson et al. |
| 2022/0047637 | A1 | 2/2022 | Lamothe-Dreuzy et al. |
| 2022/0098572 | A1 | 3/2022 | Slaymaker et al. |
| 2022/0119785 | A1 | 4/2022 | Liu et al. |
| 2022/0127594 | A1 | 4/2022 | Gaudelli et al. |
| 2022/0133790 | A1 | 5/2022 | Gehrke |
| 2022/0136012 | A1 | 5/2022 | Gaudelli et al. |
| 2022/0169998 | A1 | 6/2022 | Joung et al. |
| 2022/0170027 | A1 | 6/2022 | Gaudelli et al. |
| 2022/0220462 | A1 | 7/2022 | Liu et al. |
| 2022/0290115 | A1 | 9/2022 | Liu et al. |
| 2022/0290134 | A1 | 9/2022 | Jin et al. |
| 2022/0290164 | A1 | 9/2022 | Ran et al. |
| 2022/0307003 | A1 | 9/2022 | Liu |
| 2022/0387622 | A1 | 12/2022 | Gehrke et al. |
| 2023/0075877 | A1 | 3/2023 | Gaudelli et al. |
| 2023/0080198 | A1 | 3/2023 | Gaudelli |
| 2023/0101597 | A1 | 3/2023 | Gaudelli et al. |
| 2023/0108687 | A1 | 4/2023 | Liu et al. |
| 2023/0140953 | A1 | 5/2023 | Slaymaker et al. |
| 2023/0159956 | A1 | 5/2023 | Bryson et al. |
| 2023/0212575 | A1 | 7/2023 | Odate et al. |
| 2023/0348883 | A1 | 11/2023 | Liu et al. |
| 2023/0383277 | A1 | 11/2023 | Cafferty et al. |
| 2023/0407277 | A1 | 12/2023 | Joung et al. |
| 2024/0132867 | A1 | 4/2024 | Gaudelli et al. |

FOREIGN PATENT DOCUMENTS

| | | |
|---|---|---|
| CN | 106061510 A | 10/2016 |
| CN | 106916852 A | 7/2017 |
| CN | 107043779 A | 8/2017 |
| CN | 107109413 A | 8/2017 |
| CN | 107532161 A | 1/2018 |

(56) References Cited

FOREIGN PATENT DOCUMENTS

| | | |
|---|---|---|
| CN | 108064282 A | 5/2018 |
| CN | 108290933 A | 7/2018 |
| CN | 108513575 A | 9/2018 |
| CN | 108699116 A | 10/2018 |
| CN | 109295186 A | 2/2019 |
| CN | 109328231 A | 2/2019 |
| CN | 109957569 A | 7/2019 |
| CN | 110214180 A | 9/2019 |
| EP | 2877490 B1 | 9/2018 |
| EP | 3956349 A1 | 2/2022 |
| JP | 2017500035 A | 1/2017 |
| JP | 6629734 A2 | 1/2020 |
| KR | 20160050069 A | 5/2016 |
| WO | 1997025416 A2 | 7/1997 |
| WO | 2001038547 A2 | 5/2001 |
| WO | 2002068676 A2 | 9/2002 |
| WO | 2002103028 A2 | 12/2002 |
| WO | 2010132092 A2 | 11/2010 |
| WO | 2011075627 A1 | 6/2011 |
| WO | 2013045632 A1 | 4/2013 |
| WO | 2013176772 A1 | 11/2013 |
| WO | 2013188037 A2 | 12/2013 |
| WO | 2014004336 A2 | 1/2014 |
| WO | 2014089290 A1 | 6/2014 |
| WO | 2014184143 A1 | 11/2014 |
| WO | 2014184741 A1 | 11/2014 |
| WO | 2014186686 A2 | 11/2014 |
| WO | 2015006294 A2 | 1/2015 |
| WO | 2015006498 A2 | 1/2015 |
| WO | 2015021426 A1 | 2/2015 |
| WO | 2015089277 A1 | 6/2015 |
| WO | 2015089406 A1 | 6/2015 |
| WO | 2015090230 A1 | 6/2015 |
| WO | 2015092024 A2 | 6/2015 |
| WO | 2015133554 A1 | 9/2015 |
| WO | 2015142675 A2 | 9/2015 |
| WO | 2015191693 A2 | 12/2015 |
| WO | 2016011210 A2 | 1/2016 |
| WO | 2016016343 A1 | 2/2016 |
| WO | 2016061368 A1 | 4/2016 |
| WO | 2016069910 A1 | 5/2016 |
| WO | 2016072399 A1 | 5/2016 |
| WO | 2016073649 A1 | 5/2016 |
| WO | 2016075612 A1 | 5/2016 |
| WO | 2016094304 A2 | 6/2016 |
| WO | 2016138038 A1 | 9/2016 |
| WO | 2016142532 A2 | 9/2016 |
| WO | 2016172727 A1 | 10/2016 |
| WO | 2016183438 A1 | 11/2016 |
| WO | 2016196308 A1 | 12/2016 |
| WO | 2016196388 A1 | 12/2016 |
| WO | 2016196655 A1 | 12/2016 |
| WO | 2016205711 A1 | 12/2016 |
| WO | 2016205759 A1 | 12/2016 |
| WO | 2017011721 A1 | 1/2017 |
| WO | 2017048969 A1 | 3/2017 |
| WO | 2017049166 A1 | 3/2017 |
| WO | 2017070632 A2 | 4/2017 |
| WO | 2017070633 A2 | 4/2017 |
| WO | 2017077386 A1 | 5/2017 |
| WO | 2017079703 A1 | 5/2017 |
| WO | 2017079705 A1 | 5/2017 |
| WO | 2017093804 A2 | 6/2017 |
| WO | 2017132580 A2 | 8/2017 |
| WO | 2017165862 A1 | 9/2017 |
| WO | 2017173054 A1 | 10/2017 |
| WO | 2017180993 A1 | 10/2017 |
| WO | 2017184768 A1 | 10/2017 |
| WO | 2017189308 A1 | 11/2017 |
| WO | 2018020323 A2 | 2/2018 |
| WO | 2018027036 A1 | 2/2018 |
| WO | 2018027078 A1 | 2/2018 |
| WO | 2018035388 A1 | 2/2018 |
| WO | 2018041973 A1 | 3/2018 |
| WO | 2018071868 A1 | 4/2018 |
| WO | 2018085690 A1 | 5/2018 |
| WO | 2018089664 A1 | 5/2018 |
| WO | 2018119354 A1 | 6/2018 |
| WO | 2018119359 A1 | 6/2018 |
| WO | 2018129129 A1 | 7/2018 |
| WO | 2018160768 A1 | 9/2018 |
| WO | 2018165629 A1 | 9/2018 |
| WO | 2018176009 A1 | 9/2018 |
| WO | 2018213708 A1 | 11/2018 |
| WO | 2018213726 A1 | 11/2018 |
| WO | 2018218188 A2 | 11/2018 |
| WO | 2019005884 A1 | 1/2019 |
| WO | 2019005886 A1 | 1/2019 |
| WO | 2019023680 A1 | 1/2019 |
| WO | 2019040650 A1 | 2/2019 |
| WO | 2019071274 A1 | 4/2019 |
| WO | 2019079347 A1 | 4/2019 |
| WO | 2019120310 A1 | 6/2019 |
| WO | 2019139645 A2 | 7/2019 |
| WO | 2019183000 A1 | 9/2019 |
| WO | 2019217941 A1 | 11/2019 |
| WO | 2019217942 A1 | 11/2019 |
| WO | 2019217943 A1 | 11/2019 |
| WO | 2019217944 A1 | 11/2019 |
| WO | 2019226953 A1 | 11/2019 |
| WO | 2020028823 A1 | 2/2020 |
| WO | 2020041751 A1 | 2/2020 |
| WO | 2020051561 A1 | 3/2020 |
| WO | 2020051562 A2 | 3/2020 |
| WO | 2020112870 A1 | 6/2020 |
| WO | 2020160514 A1 | 8/2020 |
| WO | 2020160517 A1 | 8/2020 |
| WO | 2020163396 A1 | 8/2020 |
| WO | 2020168051 A1 | 8/2020 |
| WO | 2020168075 A1 | 8/2020 |
| WO | 2020168088 A1 | 8/2020 |
| WO | 2020168122 A1 | 8/2020 |
| WO | 2020168132 A1 | 8/2020 |
| WO | 2020168133 A1 | 8/2020 |
| WO | 2020168135 A1 | 8/2020 |
| WO | 2020214842 A1 | 10/2020 |
| WO | 2020236936 A1 | 11/2020 |
| WO | 2020236982 A1 | 11/2020 |
| WO | 2021020884 A2 | 2/2021 |
| WO | 2021022043 A2 | 2/2021 |
| WO | 2021042062 A2 | 3/2021 |
| WO | 2021050571 A1 | 3/2021 |
| WO | 2021055459 A1 | 3/2021 |
| WO | 2021081264 A1 | 4/2021 |
| WO | 2021087182 A1 | 5/2021 |
| WO | 2021108717 A2 | 6/2021 |
| WO | 2021158921 A2 | 8/2021 |
| WO | 2021175288 A1 | 9/2021 |
| WO | 2021207651 A2 | 10/2021 |
| WO | 2022008935 A1 | 1/2022 |
| WO | 2022015969 A1 | 1/2022 |
| WO | 2022056254 A2 | 3/2022 |
| WO | 2022056324 A1 | 3/2022 |
| WO | 2022081890 A1 | 4/2022 |
| WO | 2022112404 A1 | 6/2022 |
| WO | 2022148955 A1 | 7/2022 |
| WO | 2022150367 A1 | 7/2022 |
| WO | 2022150372 A1 | 7/2022 |
| WO | 2022150706 A2 | 7/2022 |
| WO | 2022204574 A1 | 9/2022 |
| WO | 2023279118 A2 | 1/2023 |
| WO | 2023288304 A1 | 1/2023 |
| WO | 2023034959 A2 | 3/2023 |
| WO | 2023047338 A1 | 3/2023 |
| WO | 2023049299 A2 | 3/2023 |
| WO | 2023125814 A1 | 7/2023 |
| WO | 2023155901 A1 | 8/2023 |
| WO | 2023193536 A1 | 10/2023 |
| WO | 2023227669 A3 | 11/2023 |
| WO | 2023247753 A1 | 12/2023 |
| WO | 2023248110 A1 | 12/2023 |
| WO | 2024040083 A1 | 2/2024 |
| WO | 2024063273 A1 | 3/2024 |
| WO | 2024073385 A2 | 6/2024 |

(56) References Cited

FOREIGN PATENT DOCUMENTS

| WO | 2024179426 A2 | 9/2024 |
|---|---|---|
| WO | 2024226156 A1 | 10/2024 |
| WO | 2024227047 A2 | 10/2024 |
| WO | 2024259364 A2 | 12/2024 |

OTHER PUBLICATIONS

Ahern. Biochemical, Reagents Kits Offer Scientists Good Return On Investment. The Scientist Magazine (1995) (accessed at https://www.the-scientist.com/technology/biochemical-reagents-kits-offer-scientists-good-return-on-investment-58425 on Dec. 14, 2023) (Year: 1995).*

Lange et al. Expanding the Definition of the Classical Bipartite Nuclear Localization Signal. Traffic. Mar. 2010;11(3):311-23. (Year: 2010).*

Murugan et al. The Revolution Continues: Newly Discovered Systems Expand the CRISPR-Cas Toolkit. Mol Cell. Oct. 5, 2017;68(1): 15-25. (Year: 2017).*

Chiang et al. CRISPR-Cas9D10A nickase-based genotypic and phenotypic screening to enhance genome editing. Sci Rep. Apr. 15, 2016;6:24356. (Year: 2016).*

Pace et al. Sickle Cell Disease: Genetics, Cellular and Molecular Mechanisms, and Therapies. Anemia. 2012; 2012: 143594. (Year: 2012).*

Nishimasu et al. Crystal Structure of Staphylococcus aureus Cas9. Cell. Aug. 27, 2015;162(5):1113-26. (Year: 2015).*

Wang et al, "Enhanced base editing by co-expression of free uracil DNA glycosylase inhibitor," Cell research, Oct. 2017, vol. 27, No. 10, pp. 1289-1292.

Wang et al., "Eliminating base-editor-induced genome-wide and transcriptome-wide off-target mutations," Nature Cell Biology, 2021, pp. 1-32.

Wijesinghe et al., "Efficient deamination of 5-methylcytosines in DNA by human APOBEC3A, but not by AID or APOBEC3G," Nucleic Acids Research, Jul. 13, 2012, vol. 40, No. 18, pp. 9206-9217.

Wolf et al., "tadA, an essential tRNA-specific adenosine deaminase from *Escherichia coli*," The EMBO Journal, 2002, vol. 21, No. 14, pp. 3841-3851.

Yan et al., "Functionally diverse type V CRISPR-Cas systems," Science, Jan. 4, 2019, vol. 363, pp. 88-91.

Yang et al., "Engineering and optimising deaminase fusions for genome editing," Nature Communications, 2016, vol. 7, No. 13330, pp. 1-11.

Yang et al., "PAM-Dependent Target DNA Recognition and Cleavage by C2c1 CRISPR-Cas Endonuclease," Cell, Dec. 15, 2016, vol. 167, pp. 1814-1828.

Yu et al., "Cytosine base editors with minimized unguided DNA and RNA off-target events and high on-target activity," Nature Communications, 2020, vol. 11, No. 2052, pp. 1-10.

Zafra et al., "Optimized base editors enable efficient editing in cells, organoids and mice," Nature Biotechnology, 2018, pp. 1-6.

Zheng et al., "DNA Editing in DNA/RNA Hybrids by Adenosine Deaminases That Act on RNA," Nucleic Acids Research, 2017, vol. 45, No. 6, pp. 3369-3377.

Zhou et al., "Atypical behaviour and connectivity in SHANK3-mutant macaques," Nature, Jun. 20, 2019, vol. 570, pp. 326-331.

Zuris et al., "Efficient Delivery of Genome-Editing Proteins In Vitro and In Vivo," Nature Biotechnology, Jan. 2015, vol. 33, No. 1, pp. 73-80.

International Search Report and Written Opinion in corresponding International Patent Application No. PCT/US19/50112, mailed Feb. 25, 2020 (20 pages).

U.S. Appl. No. 14/325,815, filed Jul. 6, 2021, Liu et al.

Addgene Plasmid No. 44246, Create Date Feb. 28, 2013.

Addgene Plasmid No. 73021, Create Date Apr. 20, 2016.

Addgene Plasmid No. 79620, Create Date Aug. 4, 2016.

Alexandrov et al., "Signatures of mutational processes in human cancer," Nature, Aug. 22, 2013, vol. 500, pp. 415-421.

Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.

Bae et al., "Cas-OFFinder: a fast and versatile algorithm that searches for potential off-target sites of Cas9 RNA-guided endonucleases," Bioinformatics, Jan. 24, 2014, vol. 30, No. 10, pp. 1473-1475.

Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079.

Branden and Tooze, "The Building Blocks," Introduction to Protein Structure, 1999, vol. 2, pp. 3-12.

Briner et al., "Guide RNA Functional Modules Direct Cas9 Activity and Orthogonality," Molecular Cell, Oct. 23, 2014, vol. 56, pp. 333-339.

Bulow et al., "Multienzyme systems obtained by gene fusion," Trends in Biotechnology, Jan. 1991, vol. 9, pp. 226-231.

Cameron, Ewan R., "Recent Advances in Transgenic Technology," Molecular Biotechnology, 1997, vol. 7, pp. 253-265.

Chatterjee et al., "A Cas9 with PAM recognition for adenine dinucleotides," Nature Communications, 2020, vol. 11, No. 2474, pp. 1-6.

Chester et al., "The apolipoprotein B mRNA editing complex performs a multifunctional cycle and suppresses nonsense-mediated decay," The EMBO Journal, 2003, vol. 22, No. 15, pp. 3971-3982.

Chichili et al., "Linkers in the structural biology of protein-protein interactions," Protein Science, 2013, vol. 22, pp. 153-167.

Chylinski et al., "The tracrRNA and Cas9 families of type II CRISPR-Cas immunity systems," RNA Biology, May 2013, vol. 10, No. 5, pp. 726-737.

Collantes et al., "Development and Characterization of a Modular CRISPR and RNA Aptamer Mediated Base Editing System," The CRISPR Journal, 2021, vol. 4, No. 1, pp. 58-68.

Cong et al., "Multiplex Genome Engineering Using CRISPR/Cas Systems," Science, Feb. 15, 2013, vol. 339, No. 6121, pp. 819-823.

Deltcheva et al., "CRISPR RNA maturation by trans-encoded small RNA and host factor RNase III," Nature, Mar. 31, 2011, vol. 471, pp. 602-607.

Endo et al., "Toward establishing an efficient and versatile gene targeting system in higher plants," Biocatalysis and Agricultural Biotechnology, 2014, vol. 3, pp. 2-6.

Ferretti et al., "Complete genome sequence of an M1 strain of *Streptococcus pyogenes*," Proceedings of the National Academy of Sciences of the United States of America, Apr. 10, 2001, vol. 98, No. 8, pp. 4658-4663.

Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.

Freshney et al., "Culture of Animal Cells, A Manual of Basic Technique," Food and Chemical Toxicology, 1983, vol. 23, No. 3, pp. 403-404.

Fu et al., "Human cell based directed evolution of adenine base editors with improved efficiency," Nature Communications, 2021, vol. 12, No. 5897, pp. 1-11.

Gardlik et al., "Vectors and delivery systems in gene therapy," Medical Science Monitor, 2005, vol. 11, No. 4, pp. RA110-RA121.

Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.

Gasiunas et al., "RNA-dependent DNA endonuclease Cas9 of the CRISPR system: Holy Grail of genome editing?" Trends in Microbiology, Nov. 2013, vol. 21, No. 11, pp. 562-567.

Gaudelli et al., "Directed evolution of adenine base editors with increased activity and therapeutic application," Nature Biotechnology, 2020, pp. 1-15.

(56) References Cited

OTHER PUBLICATIONS

Gaudelli et al., "Programmable base editing of A•T to G•C in genomic DNA without DNA cleavage," Nature, Nov. 23, 2017, vol. 551, pp. 464-471.
GenBank Accession No. NM_000295.4, "*Homo sapiens* serpin family A member 1 (SERPINA1), transcript variant 1, mRNA," Apr. 16, 2018, [retrieved Aug. 13, 2019] (online). Available on the Internet <https://www.ncbi.nlm.nih.gov/nuccore/NM_000295.4>.
Grunewald et al., "CRISPR DNA base editors with reduced RNA off-target and self-editing activities," Nature Biotechnology, Sep. 2019, vol. 37, No. 9, pp. 1041-1048.
Guilinger et al., "Fusion of catalytically inactive Cas9 to FokI nuclease improves the specificity of genome modification," Nature Biotechnology, 2014, pp. 1-6.
Guo et al., "Protein tolerance to random amino acid change," Proceedings of the National Academy of Sciences of the United States of America, Jun. 22, 2004, vol. 101, No. 25, pp. 9205-9210.
Hill et al., "Functional Analysis of Conserved Histidines in ADP-Glucose Pyrophosphorylase from *Escherichia coli*," Biochemical Biophysical Research Communications, 1998, vol. 244, No. 2, pp. 573-577.
Houdebine, Louis-Marie, "The methods to generate transgenic animals and to control transgene expression," Journal of Biotechnology, 2002, vol. 98, pp. 145-160.
Hu et al., "Evolved Cas9 variants with broad PAM compatibility and high DNA specificity," Nature, Apr. 5, 2018, vol. 556, pp. 57-63.
Huang et al., "DNA epigenome editing using CRISPR-Cas SunTag-directed DNMT3A," Genome Biology, 2017, vol. 18, No. 176, pp. 1-11.
Jeong et al., "Adenine base editor engineering reduces editing of bystander cytosines," Nature Biotechnology, 2021, pp. 1-12.
Jeong et al., "Precise adenine base editors that exhibit minimized cytosine catalysis," Research Square, 2020, pp. 1-15.
Jha et al., "Single amino acid substitutions in recombinant plant-derived human α1-proteinase inhibitor confer enhanced stability and functional efficacy," Biochimica et Biophysica Acta, 2014, vol. 1840, pp. 416-427.
Jiang et al., "Chemical modifications of adenine base editor mRNA and guide RNA expand its application scope," Nature Communications, 2020, vol. 11, No. 1979, pp. 1-9.
Jinek et al., "A Programmable Dual-RNA-Guided DNA Endonuclease in Adaptive Bacterial Immunity," Science, Aug. 17, 2012, vol. 337, No. 6096, pp. 816-821.
Jinek et al., "RNA-programmed genome editing in human cells," eLife, 2013, vol. 2, No. e00471, pp. 1-9.
Jore et al., "Structural basis for CRISPR RNA-guided DNA recognition by Cascade," Nature Structural & Molecular Biology, May 2011, vol. 18, No. 5, pp. 529-537.
Kappel et al., "Regulating gene expression in transgenic animals," Current Opinion in Biotechnology, 1992, vol. 3, pp. 548-553.
Kim et al., "Adenine base editors catalyze cytosine conversions in human cells," Nature Biotechnology, Oct. 2019, vol. 37, pp. 1145-1148.
Kim et al., "Highly efficient RNA-guided genome editing in human cells via delivery of purified Cas9 ribonucleoproteins," Genome Research, 2014, vol. 24, pp. 1012-1019.
Kim et al., "Increasing the genome-targeting scope and precision of base editing with engineered Cas9-cytidine deaminase fusions," Nature Biotechnology, 2017, pp. 1-7.
Kim et al., "Rescue of high-specificity Cas9 variants using sgRNAs with matched 5' nucleotides," Genome Biology, 2017, vol. 18, No. 218, pp. 1-6.
Kim et al., "Transcriptional Repression by Zinc Finger Peptides," The Journal of Biological Chemistry, Nov. 21, 1997, vol. 272, No. 47, pp. 29795-29800.
Kim et al., "Structural and Kinetic Characterization of *Escherichia Coli* TadA, the Wobble-Specific TRNA Deaminase," Biochemistry, 2006, vol. 45, No. 20, pp. 6407-6416.

Bolukbasi et al., "DNA-binding-domain fusions enhance the targeting range and precision of Cas9," Nature Methods, Dec. 2015, vol. 12, Article No. 12, pp. 1150-1156.
Burstein et al., "New CRISPR-Cas systems from uncultivated microbes," Nature, Feb. 9, 2017, vol. 542, Article No. 7640, pp. 237-241.
Cheng et al., "Cloning, expression and activity identification of human innate immune protein apolipoprotein B mRNA editing enzyme catalytic subunit 3A(APOBEC3A)," Chinese Journal of Cellular and Molecular Immunology, 2017, vol. 33, No. 2, pp. 179-184 [English Abstract].
Eid et al., "CRISPR base editors: genome editing without double-stranded breaks," Biochemical Journal, 2018, vol. 475, pp. 1955-1964.
Ekstrand et al., "Frequent alterations of the PI3K/AKT/mTOR pathways in hereditary nonpolyposis colorectal cancer," Familial Cancer, 2010, vol. 9, pp. 125-129.
Grunewald et al., "Transcriptome-wide off-target RNA editing induced by CRISPR-guided DNA base editors," Nature, May 16, 2019, vol. 569, pp. 433-437 and pp. 438-453 containing Methods, Figures, Tables and Report Summary (21 total pages).
Hua et al., "Expanding the base editing scope in rice by using Cas9 variants," Plant Biotechnology Journal, 2019, vol. 17, pp. 499-504.
Huang et al., "Circularly permuted and PAM-modified Cas9 variants broaden the targeting scope of base editors," Nature Biotechnology, Jun. 2019, vol. 37, Article No. 6, pp. 626-631.
Jin et al., "Cytosine, but not adenine, base editors induce genome-wide off-target mutations in rice," Science, Apr. 19, 2019, vol. 364, pp. 292-295.
Kaya et al., "A bacterial Argonaute with noncanonical guide RNA specificity," Proceedings of the National Academy of Sciences of the United States of America, Apr. 12, 2016, vol. 113, No. 15, pp. 4057-4062.
Komor et al., "CRISPR-Based Technologies for the Manipulation of Eukaryotic Genomes," Cell, Jan. 12, 2017, vol. 168, pp. 20-36.
Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.
Lavergne et al., "Defects in type IIA von Willebrand disease: a cysteine 509 to arginine substitution in the mature von Willebrand factor disrupts a disulphide loop involved in the interaction with platelet glycoprotein Ib-IX," British Journal of Haematology, 1992, vol. 82, pp. 66-72.
Lee et al., "CRISPR-Pass: Gene Rescue of Nonsense Mutations Using Adenine Base Editors," Molecular Therapy, Aug. 2019, vol. 27, No. 8, pp. 1364-1371.
Lee et al., "Cytosine but not adenine base editor generates mutations in mice," bioRxiv, 2019, pp. 1-24.
Micozzi et al., "Human cytidine deaminase: A biochemical characterization of its naturally occurring variants," International Journal of Biological Macromolecules, Feb. 2014, vol. 63, pp. 64-74.
Plosky, Brian S., "CRISPR-Mediated Base Editing without DNA Double-Strand Breaks," Molecular Cell, May 19, 2016, vol. 62, pp. 477-478.
Ramakrishna et al., "Gene disruption by cell-penetrating peptide-mediated delivery of Cas9 protein and guide RNA," Genome Research, 2014, vol. 24, pp. 1020-1027.
Ran et al., "In vivo genome editing using *Staphylococcus aureus* Cas9," Nature, Apr. 9, 2015, vol. 520, Article No. 7546, pp. 186-191.
Rees et al., "Improving the DNA specificity and applicability of base editing through protein engineering and protein delivery," Nature Communications, 2017, vol. 8, No. 15790, pp. 1-10.
Tsai et al., "GUIDE-seq enables genome-wide profiling of off-target cleavage by CRISPR-Cas nucleases," Nature Biotechnology, Feb. 2015, vol. 33, Article No. 2, pp. 187-197.
UniProt Accession No. A0A5F1IHX6, downloaded Apr. 11, 2023.
UniProt Accession No. A8AD26, downloaded Apr. 11, 2023.
Yan et al., "High-efficiency and multiplex adenine base editing in plants using new TadA variants," Molecular Plant, May 3, 2021, vol. 14, pp. 722-731.

(56) References Cited

OTHER PUBLICATIONS

Yang et al., "Increasing targeting scope of adenosine base editors in mouse and rat embryos through fusion of TadA deaminase with Cas9 variants," Protein & Cell, 2018, vol. 9, No. 9, pp. 814-819.

Yeh et al., "In vivo base editing of post-mitotic sensory cells," Nature Communications, 2018, vol. 9, No. 2184, pp. 1-10.

Zhang et al., "Progress in base editing technology based on CRISPR/Cas9 system and its application in medical research," Chinese Journal of Pharmacology and Toxicology, Jul. 2018, vol. 32, No. 7, pp. 507-514 [English Abstract].

Zhou et al., "Off-target RNA mutation induced by DNA base editing and its elimination by mutagenesis," Nature, Jul. 11, 2019, vol. 571, pp. 275-278 and 14 pages containing Methods, Extended Figures, and Report Summary (18 total pages).

Zuo et al., "Cytosine base editor generates substantial off-target single-nucleotide variants in mouse embryos," Science, Apr. 19, 2019, vol. 364, Article No. 6437, pp. 289-292.

Qianqian, Xiong, "Advances in Diagnosis and Treatment of Glycogen Storage Diseases," Journal of Stroke and Neurological Diseases, 2017, vol. 34, No. 10, pp. 957-960 [English Abstract].

Qing et al., "Research progress on double-stranded RNA-specific adenosine deaminase—DSRAD/ADAR1," Foreign Medical Sciences, 2004, vol. 3, pp. 129-132 [English Abstract Only].

Rajamohan et al., "Current status of drug screening and disease modelling in human pluripotent stem cells," Bioessays, 2012, vol. 35, pp. 281-298.

Ribeiro et al., "Protein Engineering Strategies to Expand CRISPR-Cas9 Applications," Hindawi: International Journal of Genomics, 2018, vol. 2018, Article No. 1652567, pp. 1-12.

Ryu et al., "Adenine base editing in mouse embryos and an adult mouse model of Duchenne muscular dystrophy," Nature Biotechnology, Jun. 2018, vol. 36, No. 6, pp. 536-539.

Sang et al., "A unique uracil-DNA binding protein of the uracil DNA glycosylase superfamily," Nucleic Acids Research, Sep. 30, 2015, vol. 43, No. 17, pp. 8452-8463.

Sangkitporn et al., "Hb G Makassar (Beta 6: Glu→ Ala) in a Thai Family," Journal of the Medical Association of Thailand, May 2002, vol. 85, No. 5, pp. 577-582.

Shah et al., "Efficient and versatile CRISPR engineering of human neurons in culture to model neurological disorders," Wellcome Open Research, Nov. 15, 2016, vol. 1, No. 13, pp. 1-18 and pp. 19-21 containing Open Peer Review (21 total pages).

Shah et al., "MeCP2 mutations: progress towards understanding and treating Rett syndrome," Genome Medicine, 2017, vol. 9, No. 17, pp. 1-4.

Shee et al., "Engineered proteins detect spontaneous DNA breakage in human and bacterial cells," eLife, 2013, vol. 2, No. e01222, pp. 1-25.

Shen et al., "Amelioration of Alpha-1 Antitrypsin Deficiency Diseases with Genome Editing in Transgenic Mice," Human Gene Therapy, 2018, vol. 29, No. 8, pp. 861-873.

Sinnamon et al., "Site-directed RNA repair of endogenous Mecp2 RNA in neurons," Proceedings of the National Academy of Sciences of the United States of America, Oct. 16, 2017, pp. E9395-E9402.

Smith et al., "Efficient and Allele-Specific Genome Editing of Disease Loci in Human iPSCs," Molecular Therapy, Mar. 2015, vol. 23, No. 3, pp. 570-577.

UniProt Accession No. P51908, Downloaded Jan. 9, 2024.

Valdmanis et al., "Future of rAAV Gene Therapy: Platform for RNAi, Gene Editing, and Beyond," Human Gene Therapy, 2017, vol. 28, No. 4, pp. 361-372.

Wei et al., "The "new favorite" of gene editing technology-single base editors," Hereditas, 2017, vol. 39, No. 12, pp. 1115-1121 [English Abstract].

Werder et al., "Adenine base editing reduces misfolded protein accumulation and toxicity in alpha-1 antitrypsin deficient patient iPSC-hepatocytes," Molecular Therapy, Nov. 2021, vol. 29, No. 11, pp. 3219-3229.

Wienert et al., "KLF1 drives the expression of fetal hemoglobin in British HPFH," Blood, Aug. 10, 2017, vol. 130, No. 6, pp. 803-807.

Yang et al., "APOBEC: From mutator to editor," Journal of Genetics and Genomics, 2017, vol. 44, pp. 423-437.

Yuliang et al., "Diagnosis and treatment of a1-antitrypsin deficiency," Practical Clinical Medicine, 2017, vol. 2, pp. 104-107 [English Abstract Only].

Zong et al., "Precise base editing in rice, wheat and maize with a Cas9-cytidine deaminase fusion," Nature Biotechnology, 2017, pp. 1-4.

Kitamura et al., "Uracil DNA Glycosylase Counteracts APOBEC3G-Induced Hypermutation of Hepatitis B Viral Genomes: Excision Repair of Covalently Closed Circular DNA," PLOS Pathogens, May 2013, vol. 9, No. 5, e1003361, pp. 1-14.

Kleinstiver et al., "Broadening *Staphylococcus aureus* Cas9 Targeting Range by Modifying PAM Recognition," Nature Biotechnology, Dec. 2015, vol. 33, No. 12, pp. 1293-1298.

Kleinstiver et al., "Engineered CRISPR-Cas9 nucleases with altered PAM specificities," Nature, Jul. 23, 2015, vol. 523, pp. 481-485.

Kleinstiver et al., "High-fidelity CRISPR-Cas9 variants with undetectable genome-wide off-targets," Molecular Therapy, Jan. 28, 2016, vol. 529, No. 75187, pp. 490-495.

Koblan et al., "Improving cytidine and adenine base editors by expression optimization and ancestral reconstruction," Nature Biotechnology, 2018, pp. 1-4.

Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.

Komor et al., "Programmable editing of a target base in genomic DNA without double-stranded DNA cleavage," Nature, May 19, 2016, vol. 533, pp. 420-424.

Kundu et al., "Leucine to proline substitution by SNP at position 197 in Caspase-9 gene expression leads to neuroblastoma: a bioinformatics analysis," 3 Biotech, 2013, vol. 3, pp. 225-234.

Lapinaite et al., "DNA capture by a CRISPR-Cas9-guided adenine base editor," Science, Jul. 31, 2020, vol. 369, No. 6503, pp. 566-571.

Lau et al., "Molecular basis for discriminating between normal and damaged bases by the human alkyladenine glycosylase, AAG," Proceedings of the National Academy of Sciences of the United States of America, Dec. 5, 2000, vol. 97, No. 25, pp. 13573-13578.

Lazar et al., "Transforming Growth Factor a: Mutation of Aspartic Acid 47 and Leucine 48 Results in Different Biological Activities," Molecular and Cellular Biology, Mar. 1988, vol. 8, No. 3, pp. 1247-1252.

Lee et al., "PIK3CA gene is frequently mutated in breast carcinomas and hepatocellular carcinomas," Oncogene, 2005, vol. 24, pp. 1477-1480.

Lenk et al., "Pathogenic Mechanism of the FIG4 Mutation Responsible for Charcot-Marie-Tooth Disease CMT4J," PLoS Genetics, Jun. 2011, vol. 7, No. 6, e1002104, pp. 1-13.

Li et al., "Current Approaches for Engineering Proteins with Diverse Biological Properties," Bio-Applications of Nanoparticles, 2007, pp. 1-16.

Liu et al., "C2c1-sgRNA Complex Structure Reveals RNA-Guided DNA Cleavage Mechanism," Molecular Cell, Jan. 19, 2017, vol. 65, pp. 310-322.

Lyons et al., "Efficient Recognition of an Unpaired Lesion by a DNA Repair Glycosylase," Journal of the American Chemical Society, 2009, vol. 131, No. 49, pp. 17742-17743.

Ma et al., "Targeted AID-mediated mutagenesis (TAM) enables efficient genomic diversification in mammalian cells," Nature Methods, Dec. 2016, vol. 13, No. 12, pp. 1029-1035.

Makarova et al., "Classification and Nomenclature of CRISPR-Cas Systems: Where from Here?," The CRISPR Journal, 2018, vol. 1, No. 5, pp. 325-336.

Mali et al., "Cas9 as a versatile tool for engineering biology," Nature Methods, Oct. 2013, vol. 10, No. 10, pp. 957-963.

Mali et al., "CAS9 transcriptional activators for target specificity screening and paired nickases for cooperative genome engineering," Nature Biotechnology, 2013, pp. 1-6.

Mccann et al., "MagnEdit—interacting factors that recruit DNA-editing enzymes to single base targets," Life Science Alliance, 2020, vol. 3, No. 4, e201900606, pp. 1-9.

(56) References Cited

OTHER PUBLICATIONS

Mikami et al., "Comparison of CRISPR/Cas9 expression constructs for efficient targeted mutagenesis in rice," Plant Molecular Biology, 2015, vol. 88, pp. 561-572.
Miller et al., "Continuous evolution of SpCas9 variants compatible with non-G PAMs," Nature Biotechnology, Apr. 2020, vol. 38, No. 4, pp. 471-481.
Mohamad et al., "Human hemoglobin G-Makassar variant masquerading as sickle cell anemia," Hematology Reports, 2018, vol. 10, No. 7210, pp. 92-95.
Mullins et al., "Transgenesis in Nonmurine Species," Hypertension, Oct. 1993, vol. 22, No. 4, pp. 630-633.
Navaratnam et al., "An Overview of Cytidine Deaminases," International Journal of Hematology, 2006, vol. 83, pp. 195-200.
Nishida et al., "Targeted nucleotide editing using hybrid prokaryotic and vertebrate adaptive immune systems," Science, Sep. 16, 2016, vol. 353, No. 6305, pp. 1248-aaf8729-8.
Nishimasu et al., "Engineered CRISPR-Cas9 nuclease with expanded targeting space," Science, Sep. 21, 2018, vol. 361, pp. 1259-1262.
Okumura et al., "Evolutionary paths of streptococcal and staphylococcal superantigens," BMC Genomics, 2012, vol. 13, No. 404, pp. 1-16.
Parr et al., "N1-Methylpseudouridine substitution enhances the performance of synthetic mRNA switches in cells," Nucleic Acids Research, 2020, vol. 48, No. 6, e35, pp. 1-9.
Pausch et al., "CRISPR-CasΦ from huge phages is a hypercompact genome editor," Science, Jul. 17, 2020, vol. 369, No. 6501, pp. 333-337.
Phillips, Anthony J., "The challenge of gene therapy and DNA delivery," Journal of Pharmacy and Pharmacology, 2001, vol. 53, pp. 1169-1174.
Poller et al., "A Leucine-to-Proline Substitution Causes a Defective α1-Antichymotrypsin Allele Associated with Familial Obstructive Lung Disease," Genomics, 1993, vol. 17, pp. 740-743.
Putnam et al., "Protein Mimicry of DNA from Crystal Structures of the Uracil-DNA Glycosylase Inhibitor Protein and ts Complex with *Escherichia coli* Uracil-DNA Glycosylase," Journal of Molecular Biology, 1999, vol. 287, pp. 331-346.
Qi et al., "Repurposing CRISPR as an RNA-Guided Platform for Sequence-Specific Control of Gene Expression," Cell, Feb. 28, 2013, vol. 152, pp. 1173-1183.
Rees et al., "Analysis and minimization of cellular RNA editing by DNA adenine base editors," Science Advances, May 8, 2019, vol. 5, No. eaax5717, pp. 1-10.
Rees et al., "Base editing: precision chemistry on the genome and transcriptome of living cells," Nature Reviews Genetics, Dec. 2018, vol. 19, No. 12, pp. 770-788.
Richter et al., "Phage-assisted evolution of an adenine base editor with improved Cas domain compatibility and activity," Nature Biotechnology, Jul. 2020, vol. 38, No. 7, pp. 883-891.
Sang, Helen, "Prospects for transgenesis in the chick," Mechanisms of Development, 2004, vol. 121, pp. 1179-1186.
Shimomura et al., "Complete genome sequencing and analysis of a Lancefield group G *Streptococcus dysgalactiae* subsp. *equisimilis* strain causing streptococcal toxic shock syndrome (STSS)," BMC Genomics, 2011, vol. 12, No. 17, pp. 1-17.
Shmakov et al., "Discovery and Functional Characterization of Diverse Class 2 CRISPR-Cas Systems," Molecular Cell, Nov. 5, 2015, vol. 60, pp. 385-397.
Slaymaker et al., "Rationally engineered Cas9 nucleases with improved specificity," Science, Jan. 1, 2016, vol. 351, No. 6268, pp. 84-88.
Tan et al., "Engineering of high-precision base editors for site-specific single nucleotide replacement," Nature Communications, 2019, vol. 10, No. 439, pp. 1-10.
Tanenbaum et al., "A Protein-Tagging System for Signal Amplification in Gene Expression and Fluorescence Imaging," Cell, Oct. 23, 2014, vol. 159, pp. 635-646.
Teng et al., "Mutational analysis of apolipoprotein B mRNA editing enzyme (APOBEC1): structure-function relationships of RNA editing and dimerization," Journal of Lipid Research, 1999, vol. 40, pp. 623-635.
UniProt Accession No. P01011, Create Date Jul. 21, 1986.
UniProt Accession No. Q99ZW2, Create Date Jul. 11, 2012.
UniProt Proteome ID No. UP000009215, Create Date May 2012.
Wacey et al., "Disentangling the perturbational effects of amino acid substitutions in the DNA-binding domain of p53," Human Genetics, 1999, vol. 104, pp. 15-22.
Walton et al., "Unconstrained genome targeting with near-PAMless engineered CRISPR-Cas9 variants," Science, Mar. 26, 2020, pp. 1-11.
Aratyn-Schaus et al., "[589] Base-Editing as a Therapeutic Approach for the Direct Correction of Disease-Causing Mutations Underlying Glycogen Storage Disease Type IA," AASLD Abstracts (Poster), Hepatology, Oct. 2020, vol. 72, No. Suppl. 1, pp. 354A-355A.
Azad et al., "Site-directed RNA editing by adenosine deaminase acting on RNA for correction of the genetic code in gene therapy," Gene Therapy, 2017, vol. 24, pp. 779-786.
Baligar et al., "Bone Marrow Stem Cell Therapy Partially Ameliorates Pathological Consequences in Livers of Mice Expressing Mutant Human α1-Antitrypsin," Hepatology, Apr. 2017, vol. 65, No. 4, pp. 1319-1335.
Bjursell et al., "Therapeutic Genome Editing With CRISPR/Cas9 in a Humanized Mouse Model Ameliorates 1-antitrypsin Deficiency Phenotype," EBioMedicine, 2018, vol. 29, pp. 104-111.
Canver et al., "Customizing the genome as therapy for the β-hemoglobinopathies," Blood, May 26, 2016, vol. 127, No. 21, pp. 2536-2545.
Chadwick et al., "In Vivo Base Editing of PCSK9 (Proprotein Convertase Subtilisin/Kexin Type 9) as a Therapeutic Alternative to Genome Editing," Arteriosclerosis, Thrombosis, and Vascular Biology, Sep. 2017, vol. 37, Article No. 9, pp. 1741-1747.
Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).
Fagagna et al., "The Gam protein of bacteriophage Mu is an orthologue of eukaryotic Ku," EMBO reports, 2003, vol. 4, No. 1, pp. 47-52.
Fitzhugh et al., "At least 20% donor myeloid chimerism is necessary to reverse the sickle phenotype after allogeneic HSCT," Blood, Oct. 26, 2017, vol. 130, No. 17, pp. 1946-1948.
GenBank Accession No. AIT42264.1, downloaded Jan. 9, 2024.
GenBank Accession No. AKA60242.1, downloaded Jan. 9, 2024.
GenBank Accession No. AKQ21048.1, downloaded Jan. 9, 2024.
GenBank Accession No. AKS40380.1, downloaded Jan. 9, 2024.
GenBank Locus No. LC169509.1, downloaded Aug. 10, 2023.
GenBank Protein No. 4UN5_B, downloaded Jan. 9, 2024.
Greene et al., "Alpha-1 Antitrypsin Deficiency: Recent Developments in Gene Therapy Research," Gene Therapy Application, 2011, vol. 25, pp. 449-460.
Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).
Hess et al., "Methods and Applications of CRISPR-Mediated Base Editing in Eukaryotic Genomes," Molecular Cell, Oct. 5, 2017, vol. 68, pp. 26-43.
Kleinstiver et al., "Broadening the targeting range of *Staphylococcus aureus* CRISPR-Cas9 by modifying PAM recognition," Nature Biotechnology, Dec. 2015, vol. 33, No. 12, pp. 1293-1298 and p. 1299 containing Online Methods (7 total pages).
Lei et al., "Glucose-6-phosphatase dependent substrate transport in the glycogen storage disease type-1a mouse," Nature Genetics, Jun. 1996, vol. 13, pp. 203-209.
Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].
Musallam et al., "Fetal hemoglobin levels and morbidity in untransfused patients with β-thalassemia intermedia," Blood, Jan. 12, 2012, vol. 119, No. 2, pp. 364-367.

(56) References Cited

OTHER PUBLICATIONS

NCBI Reference Sequence No. NC_000001.11, downloaded Jan. 9, 2024.
NCBI Reference Sequence No. NP_000286.3, downloaded Sep. 27, 2023.
NCBI Reference Sequence No. WP_002989955.1, downloaded Jan. 9, 2024.
NCBI Reference Sequence No. WP_010922251.1, downloaded Jan. 9, 2024.
NCBI Reference Sequence No. WP_011054416.1, downloaded Jan. 9, 2024.
NCBI Reference Sequence No. WP_011284745.1, downloaded Jan. 9, 2024.
NCBI Reference Sequence No. WP_011285506.1, downloaded Jan. 9, 2024.
NCBI Reference Sequence No. WP_011527619.1, downloaded Jan. 9, 2024.
NCBI Reference Sequence No. WP_012560673.1, downloaded Jan. 9, 2024.
NCBI Reference Sequence No. WP_014407541.1, downloaded Jan. 9, 2024.
NCBI Reference Sequence No. WP_020905136.1, downloaded Jan. 9, 2024.
NCBI Reference Sequence No. WP_023080005.1, downloaded Jan. 9, 2024.
NCBI Reference Sequence No. WP_023610282.1, downloaded Jan. 9, 2024.
NCBI Reference Sequence No. WP_030125963.1, downloaded Jan. 9, 2024.
NCBI Reference Sequence No. WP_030126706.1, downloaded Jan. 9, 2024.
NCBI Reference Sequence No. WP_031488318.1, downloaded Jan. 9, 2024.
NCBI Reference Sequence No. WP_032460140.1, downloaded Jan. 9, 2024.
NCBI Reference Sequence No. WP_032461047.1, downloaded Jan. 9, 2024.
NCBI Reference Sequence No. WP_032462016.1, downloaded Jan. 9, 2024.
NCBI Reference Sequence No. WP_032462936.1, downloaded Jan. 9, 2024.
NCBI Reference Sequence No. WP_032464890.1, downloaded Jan. 9, 2024.
NCBI Reference Sequence No. WP_038431314.1, downloaded Jan. 9, 2024.
NCBI Reference Sequence No. WP_038432938.1, downloaded Jan. 9, 2024.
NCBI Reference Sequence No. WP_038434062.1, downloaded Jan. 9, 2024.
NCBI Reference Sequence No. WP_048327215.1, downloaded Jan. 9, 2024.
NCBI Reference Sequence No. WP_049519324.1, downloaded Jan. 9, 2024.
Ngo et al., "Fetal haemoglobin levels and haematological characteristics of compound heterozygotes for haemoglobin S and deletional hereditary persistence of fetal haemoglobin," British Journal of Haematology, 2011, vol. 156, pp. 259-264.
Pournasr et al., "Modeling Inborn Errors of Hepatic Metabolism Using Induced Pluripotent Stem Cells," Arteriosclerosis, Thrombosis, and Vascular Biology, Nov. 2017, vol. 37, pp. 1994-1999.
UniProt Accession No. Q6JC40, Downloaded Nov. 14, 2024.
Wan et al. "Material solutions for delivery of CRISPR/Cas-based genome editing tools: current status and future outlook." Materials Today, Jun. 2019, vol. 26, pp. 40-66.
Wirth et al., "Mildly affected patients with spinal muscular atrophy are partially protected by an increased SMN2 copy number," Human Genetics, 2006, vol. 119, pp. 422-428.
Zhou et al., "Cas 12a variants designed for lower genome-wide off-target effect through stringent PAM recognition", Molecular Therapy, Jan. 2022, vol. 30, No. 1, pp. 1-12.

Baños-Sanz et al., "Crystal structure and functional insights into uracil-DNA glycosylase inhibition by phage φ29 DNA mimic protein p56," Nucleic Acids Research, 2013, vol. 41, No. 13, pp. 6761-6773.
Cartegni et al., "Determinants of Exon 7 Splicing in the Spinal Muscular Atrophy Genes, SMN1 and SMN2," The American Journal of Human Genetics, Jan. 2006, vol. 78, pp. 63-77.
Chang et al., "Degradation of survival motor neuron (SMN) protein is mediated via the ubiquitin/proteasome pathway," Neurochemistry International, 2004, vol. 45, pp. 1107-1112.
Charpentier et al. "Rewriting a genome", Nature, Mar. 2013, vol. 495, No. 7439, pp. 50-51.
Chen et al. "Targeting genomic rearrangements in tumor cells through Cas9-mediated insertion of a suicide gene." Nature Biotechnology, Jun. 2017, vol. 35, No. 6, pp. 543-552.
Cho et al., "A degron created by SMN2 exon 7 skipping is a principal contributor to spinal muscular atrophy severity," Genes & Development, 2010, vol. 24, pp. 438-442.
Corcia et al., "The importance of the SMN genes in the genetics of sporadic ALS," Amyotrophic Lateral Sclerosis, 2009, vol. 10, pp. 436-440.
Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).
Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.
De Souza. "Primer: genome editing with engineered nucleases." Nature Methods, vol. 9, No. 1, Jan. 2012, pp. 27-27.
D'Ydewalle et al., "The Antisense Transcript SMN-AS1 Regulates SMN Expression and Is a Novel Therapeutic Target for Spinal Muscular Atrophy," Neuron, Jan. 4, 2017, vol. 93, pp. 63-79.
GenBank Accession No. CTS26096.1, downloaded Apr. 9, 2024.
Geneseq, "*Streptococcus pyogenes* Cas9 protein", XP002808136, retrieved from EBI accession No. GSP: BIR16744 Database accession No. BIR16744 sequence-& DATBSE Geneseq [Online], Jan. 21, 2021.
Geneseq, "*Streptococcus pyogenes* Cas9 protein", XP002808135, retrieved from EBI accession No. GSP: BIR16747 Database accession No. BIR16747 sequence-& DATBSE Geneseq [Online], Jan. 21, 2021.
Geneseq, "Adenine deaminase polypeptide SEQ: 49.", XP002808137, retrieved from EBI accession No. GSP: BJG44493 Database accession No. BJG44493 sequence-& DATBSE Geneseq [Online], Jun. 10, 2021.
Grimm et al., In vitro and In vivo Gene Therapy Vector Evolution via Multispecies Interbreeding and Retargeting of Adeno-Associated Viruses. J. Virol., 2008, vol. 82, p. 5887-5911.
Guilinger et al. "Fusion of catalytically inactive Cas9 to FokI nuclease improves the specificity of genome modification." Nature Biotechnology, 2014, vol. 32, pp. 577-582.
Jeong et al., "Measurement of deoxyinosine adduct: Can it be a reliable tool to assess oxidative or nitrosative DNA damage?," Toxicology Letters, 2012, vol. 214, pp. 226-233.
Kim et al., "Highly efficient RNA-guided base editing in mouse embryos," Nature Biotechnology, 2017, pp. 1-4.
Le et al., "SMNΔ7, the major product of the centromeric survival motor neuron (SMN2) gene, extends survival in mice with spinal muscular atrophy and associates with full-length SMN," Human Molecular Genetics, 2005, vol. 14, No. 6, pp. 845-857.
Lefebvre et al., "Identification and Characterization of a Spinal Muscular Atrophy-Determining Gene," Jan. 13, 1995, vol. 80, pp. 155-165.
Li et al. "Base editing with a Cpf1-cytidine deaminase fusion." Nature biotechnology, 2018, vol. 36, No. 4, pp. 324-327.
Liu et al., "Research Progress of Base Editing System," World Sci-Tech R&D, Dec. 2017, vol. 39, No. 6, pp. 457-462 [English Abstract].
Liu, et al. "Crossing the blood-brain barrier with AAV vectors," Metabolic Brain Disease, 2021, vol. 36, pp. 45-52.

(56) References Cited

OTHER PUBLICATIONS

Lorson et al., "A single nucleotide in the SMN gene regulates splicing and is responsible for spinal muscular atrophy," Proceedings of the National Academy of Sciences of the United States of America, May 1999, vol. 96, pp. 6307-6311.

Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.

Maeder et al. "CRISPR RNA-guided activation of endogenous human genes", Nature Methods, Oct. 2013, vol. 10, No. 10, pp. 977-979.

Mariani et al. "Species-specific exclusion of APOBEC3G from HIV-1 virions by Vif." Cell, 2003, vol. 114, No. 1, 21-31.

Monani et al., "A single nucleotide difference that alters splicing patterns distinguishes the SMA gene SMN1 from the copy gene SMN2," Human Molecular Genetics, 1999, vol. 8, No. 7, pp. 1177-1183.

Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.

NCBI Reference Protein No. Q694B3.2, downloaded Apr. 8, 2024.

NCBI Reference Sequence No. WP_001297409.1, downloaded Aug. 14, 2023.

NCBI Reference Sequence No. WP_032188360.1, downloaded Apr. 9, 2024.

Nelson et al., "In vivo genome editing improves muscle function in a mouse model of Duchenne muscular dystrophy," Science, Jan. 22, 2016, vol. 351, No. 6271, pp. 403-407.

Newby et al. "Base editing of haematopoietic stem cells rescues sickle cell disease in mice", Nature, Nature Publishing Group UK, London, 2021, vol. 595, Article No. 7866, pp. 295-302, p. 296; Figure 1, p. 301.

O'Connell et al., Programmable RNA recognition and cleavage by CRISPR/Cas9. Nature, 2014, vol. 516, p. 263-266.

Ousterout et al., "Multiplex CRISPR/Cas9-based genome editing for correction of dystrophin mutations that cause Duchenne muscular dystrophy," Nature Communications, Feb. 2015, vol. 6, No. 6244, pp. 1-13.

Pattanayak et al., "High-throughput profiling of off-target DNA cleavage reveals RNA-programmed Cas9 nuclease specificity," Nature Biotechnology, Sep. 2013, vol. 31, No. 9, pp. 839-843.

Ranzau et al., "The wild-type tRNA adenosine deaminase enzyme TadA is capable of sequence-specific DNA base editing." Chembiochem, Aug. 2023, vol. 24, No. 16, pp. 1-35.

Riesenberg et al. "Improved gRNA secondary structures allow editing of target sites resistant to CRISPR-Cas9 cleavage." Nature communications, 2022, vol. 13 No. 1, pp. 489.

Rogozin et al. "Evolution and diversification of lamprey antigen receptors: evidence for involvement of an ID-APOBEC family cytosine deaminase," Nature Immunology, Jun. 2007, vol. 8, No. 6, pp. 647-656.

Ruffolo, et al., "Design of highly functional genome editors by modeling of the universe of CRISPR-Cas Sequences," bioRxiv, posted Apr. 22, 2024, doi: 10.1101/2024.04.22.590591.

Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.

Singh et al., "Splicing of a Critical Exon of Human Survival Motor Neuron Is Regulated by a Unique Silencer Element Located in the Last Intron," Molecular and Cellular Biology, Feb. 2006, vol. 26, No. 4, pp. 1333-1346.

Song et al. "Delivery of CRISPR/Cas systems for cancer gene therapy and immunotherapy." Advanced Drug Delivery Reviews, 2021, vol. 168, pp. 150-180.

Stanton et al. "Systemic administration of novel engineered AAV capsids facilitates enhanced transgene expression in the macaque CNS." Med, 2023, vol. 4. No. 1, pp. 31-50.

Talbot et al., "Spinal muscular atrophy," Journal of Inherited Metabolic Disease, Jun. 2001, vol. 21, No. 2, pp. 189-197 [Abstract Only].

Thorpe et al. "Functional Correction of Episomal Mutations With Short DNA Fragments and RNA-DNA Oligonucleotides." Journal of Gene Medicine, Jan. 2002, vol. 4, No. 1, pp. 195-204.

Tipanee, et al. "Transposons: Moving Forward from Preclinical Studies to Clinical Trials," Human Gene Therapy, Nov. 2017, pp. 1087-1104.

Tsai et al. "Dimeric CRISPR RNA-guided FokI nucleases for highly specific genome editing." Nature Biotechnology, Apr. 2014, vol. 32, No. 6, pp. 569-576.

Conticello, "The AID/APOBEC family of nucleic acid mutators." Genome Biology, 2008, vol. 9, No. 229 (10 pages).

Gao, et al., "DNA-guided genome editing using the Natronobacterium gregoryi Argonaute." Nature biotechnology, May 2, 2016, vol. 34 No. 7, pp. 768-773.

Gaudelli et al., "Programmable Base Editing of A•T to G•C in Genomic DNA without DNA Cleavage," Nature, Nov. 23, 2017, vol. 551, pp. 464-471 and pp. 472-487 containing Methods, Figures, Life Sciences Reporting Summary and Corrections & Amendments (37 total pages).

GenBank. "Apobec1 [Pongo Pygmaeus]—Protein—NCBI." Nih. gov, 2019, www.ncbi.nlm.nih.gov/protein/AAT44389.1?report=genbank&log. Accessed Apr. 25, 2025. (Year: 2019).

Kim et al. (2017), Supplementary Information. (Year: 2017) (29 pages).

Kleinstiver et al., "Engineered CRISPR-Cas9 nucleases with altered PAM specificities," Nature, Jul. 23, 2015, vol. 523, Article No. 7561, pp. 481-485 and pp. 24-27 containing Figures (27 total pages).

Komor et al., "Programmable Editing of a Target Base in Genomic DNA without Double-Stranded DNA Cleavage," Nature, May 19, 2016, vol. 533, pp. 420-424 and pp. 425-436 containing Methods and Figures (25 total pages).

Sawyer et al., "Ancient adaptive evolution of the primate antiviral DNA-editing enzyme APOBEC3G." PLoS Biol., Sep. 2004, vol. 2, No. 9 e275, pp. 1278-1285.

Wang et al., "BE-PIGS: a base-editing tool with deaminases inlaid into Cas9 PI domain significantly expanded the editing scope." Signal Transduction and Targeted Therapy, 2019, vol. 4, No. 36 (3 pages).

\* cited by examiner

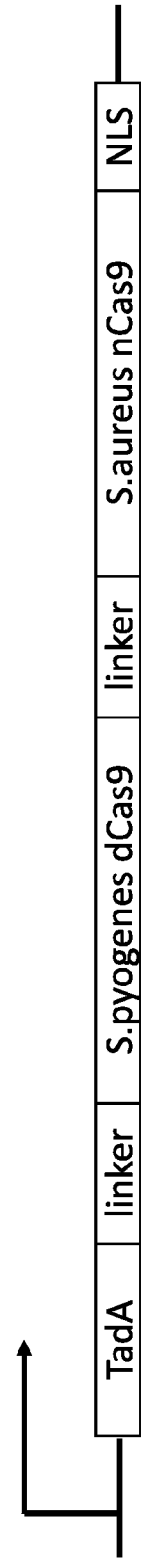
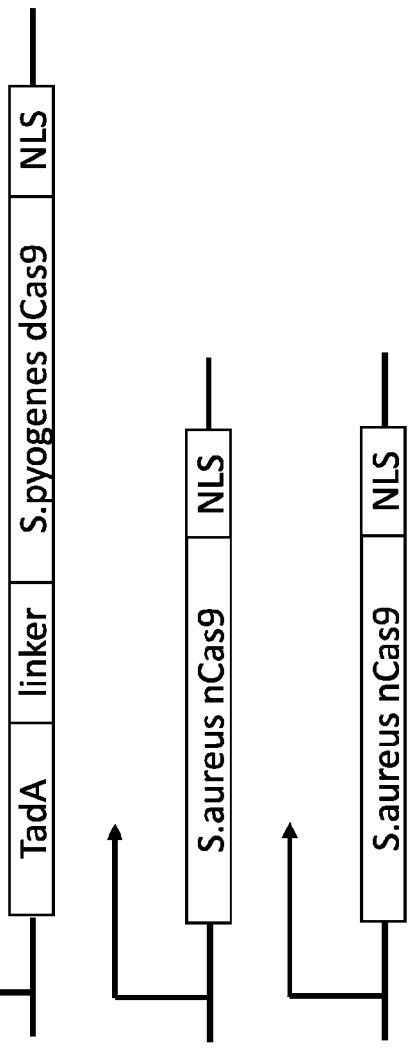
FIG. 1C
FIG. 1D

COMPOSITIONS AND METHODS FOR IMPROVING BASE EDITING

CROSS-REFERENCE TO RELATED APPLICATION

This application is the U.S. national phase application, pursuant to 35 U.S.C. § 371, of PCT International Application No.: PCT/US2019/050112, filed Sep. 7, 2019, designating the United States and published in English, which claims priority to and benefit of U.S. Provisional Patent Application No. 62/728,698, filed on Sep. 7, 2018, the entire contents of each of which are hereby incorporated by reference herein.

SEQUENCE LISTING

The instant application contains a Sequence Listing which has been submitted electronically in ASCII format and is hereby incorporated by reference in its entirety. Said ASCII copy, created on Oct. 18, 2019, is named 52885-775_601_SL.txt and is 812,881 bytes in size.

BACKGROUND OF THE INVENTION

Targeted editing of nucleic acid sequences, for example, the targeted cleavage or the targeted introduction of a specific modification into genomic DNA is a highly promising approach for the study of gene function and also has the potential to provide new therapies for human genetic diseases. Currently available base editors include cytidine base editors (e.g., BE4) that convert target C·G to T·A and adenine base editors (e.g., ABE7.10) that convert target A·T to G·C. Cas9-targeted deamination was first demonstrated in connection with a Base Editor (BE) system designed to induce base changes without introducing double-stranded DNA breaks. Rat deaminase APOBEC1 (rAPOBEC1) fused to deactivated Cas9 (dCas9) was used to successfully convert cytidines to thymidines upstream of the PAM of the sgRNA. This first BE system was optimized by changing the dCas9 to a "nickase" Cas9 D10A, which nicks the strand opposite the deaminated cytidine. Without being bound by theory, this is expected to initiate long-patch base excision repair (BER), where the deaminated strand is preferentially used to template the repair to produce a U: A base pair, which is then converted to T: A during DNA replication. While base editing efficiency was increased, the number of indels observed also increased. There is a need for improved BEs that show high base editing activity while generating fewer indels.

SUMMARY OF THE INVENTION

As described below, the present invention features compositions and methods for modifying a polynucleotide (e.g., DNA) using a nucleobase editor containing a first DNA binding protein domain that is catalytically inactive, a domain having base editing activity, and a second DNA binding protein domain having nickase activity, where the DNA binding protein domains are expressed on a single fusion protein or are expressed separately (e.g., on separate expression vectors). The invention also features a fusion protein comprising a domain having base editing activity (e.g., cytidine deaminase or adenosine deaminase), and two nucleic acid programmable DNA binding protein domains (napDNAbp), a first comprising nickase activity and a second napDNAbp that is catalytically inactive, wherein at least the two napDNAbp are joined by a linker. In one embodiment, the fusion protein comprises a DNA domain of a CRISPR-Cas (e.g., Cas9) having nickase activity (nCas; nCas9), a catalytically inactive domain of a CRISPR-Cas protein (e.g., Cas9) having nucleic acid programmable DNA binding activity (dCas; e.g., dCas9), and a deaminase domain, wherein the dCas is joined to the nCas by a linker, and the dCas is immediately adjacent to the deaminase domain, as well as related methods for using such editors, and kits comprising the editors.

Provided herein is a nucleobase editor comprising (a) a first DNA binding protein domain that lacks nuclease activity; (b) a second DNA binding protein domain comprising nickase activity, and (c) a domain comprising base editing activity, wherein the first DNA binding protein domain and the second DNA binding protein domain are heterologous. In some embodiments, the first and second DNA binding protein domains are expressed on a single fusion protein or are expressed as separate proteins. In some embodiments, the first and second DNA binding protein domains are joined by a linker to form a nucleobase editor fusion protein.

Provided herein is a nucleobase editor comprising (a) a first DNA binding protein domain that lacks nuclease activity, (b) a second DNA binding protein domain comprising nickase activity, and (c) a domain comprising base editing activity, wherein the first DNA binding protein domain and the second DNA binding protein domain are each capable of binding a guide RNA independently. Provided herein is a nucleobase editor comprising a first DNA binding protein domain that lacks nuclease activity, a domain comprising base editing activity, and a second DNA binding protein domain that comprises nickase activity, wherein the first DNA binding protein domain is a catalytically inactive Cas protein domain (dCas), wherein the first DNA binding protein domain and the second DNA binding protein domain are joined by a peptide linker, and wherein the domain comprising base editing activity is fused immediately adjacent to the dCas domain, wherein the first DNA binding protein domain and the second DNA binding protein domain are heterologous.

In some embodiments, the first DNA binding protein domain is a catalytically inactive CRISPR-Cas protein domain (dCas) or a fragment thereof capable of binding a guide RNA, a Zinc Finger domain, or a TAL effector DNA-binding domain. In some embodiments, the second DNA binding protein domain is a nickase CRISPR-Cas protein domain (nCas) or a fragment thereof capable of binding a guide RNA, a Zinc Finger nickase, a TALE nickase, or an active fragment thereof. In some embodiments, the domain having base editing activity is a cytidine deaminase domain or an adenosine deaminase domain. In some embodiments, the cytidine deaminase domain is a *Petromyzon marinus* cytosine deaminase 1 (pCDM), Apolipoprotein B mRNA editing enzyme catalytic polypeptide-like (APOBEC), or Activation-induced cytidine deaminase (AICDA). In some embodiments, the nucleobase editor further comprises a Uracil DNA glycosylase inhibitor (UGI) domain. In some embodiments, the nucleobase editor comprises two UGI domains. In some embodiments, the adenosine deaminase is a TadA, TadA7.10, or a variant thereof. In some embodiments, the nucleobase editor further comprises a Nuclear Localization Signals (NLS) fused to the first DNA binding protein domain or the second DNA binding protein domain. In some embodiments, the first DNA binding protein domain or the second DNA binding protein domain are each fused with a NLS independently. In some embodiments, the NLS is a bipartite NLS. In some embodiments, the first DNA binding protein domain is a dCas9 and the second DNA binding protein domain is a nCas9, wherein the dCas9 binds a canonical PAM sequence and the nCas9 binds a non-canonical PAM sequence. In some embodiments, the first DNA binding protein domain is a dCas9 and the second DNA binding protein domain is a nCas9, wherein the nCas9 binds a canonical PAM sequence and the dCas9 binds a non-canonical PAM sequence. In some embodiments, the nCas9 binds a non-canonical PAM sequence of Tables 1-5. In some embodiments, the dCas9 binds a non-canonical PAM sequence of Tables 1-5. In some embodiments, the first DNA binding protein domain is selected from the group consisting of a nuclease inactive Cas12a, Cas12b, Cas12c, Cas12d, Cas12e, Cas12g, Cas12h, and Cas12i or fragments thereof. In some embodiments, the second DNA binding protein domain is capable of cleaving a target nucleic acid sequence or the reverse complementary strand of the target nucleic acid sequence. In some embodiments, the second DNA binding protein domain is a nCas domain comprises a catalytic domain capable of cleaving a target nucleic acid sequence or the reverse complementary strand of the target nucleic acid sequence. In some embodiments, the nCas domain is derived from Cas12a, Cas12b, Cas12c, Cas12d, Cas12e, Cas12g, Cas12h, or Cas12i. In some embodiments, the first DNA binding protein domain is a dCas domain that comprises a domain incapable of cleaving a target nucleic acid sequence and the reverse complementary strand of the target nucleic acid sequence. In some embodiments, the dCas domain comprises a gRNA binding domain of Cas9. In some embodiments, the dCas domain is derived from Cas12a, Cas12b, Cas12c, Cas12d, Cas12e, Cas12g, Cas12h, or Cas12i. In some embodiments, the first DNA binding protein domain is a dCas9 derived from *S. pyogenes* (dSpCas9) and wherein the second DNA binding protein domain is a nCas9 derived from *S. aureus* (nSaCas9). In some embodiments, the dSpCas9 is immediately adjacent to the domain comprising base editing activity and wherein the nSaCas9 is joined to the dSpCas9 by a linker.

In some aspects, provided herein is a nucleobase editor polypeptide comprising the following domains: NH2-[A-B-C]-COOH, wherein A, B, and C, each comprises one of: a domain having base editing activity or an functional fragment thereof, a first napDNAbp domain that lacks nuclease activity and has nucleic acid sequence specific binding activity, or a functional fragment thereof; and a second napDNAbp domain that has nickase activity and nucleic acid sequence specific binding activity, or a functional fragment thereof, wherein the first and the second napDNAbp domains are heterologous and are joined by a linker.

In some embodiments, the first napDNAbp domain and the second napDNAbp domain are each capable of binding a guide RNA independently. In some embodiments, the first napDNAbp domain is a catalytically inactive CRISPR-Cas (dCas) or a fragment thereof that is capable of binding a guide RNA. In some embodiments, the second napDNAbp domain is a CRISPR-Cas nickase (nCas) or a functional fragment thereof. In some embodiments, the domain having base editing activity is a cytidine deaminase domain or an adenosine deaminase domain. In some embodiments, the cytidine deaminase is *Petromyzon marinus* cytosine deaminase 1 (pCDM), or Activation-induced cytidine deaminase (AICDA). In some embodiments, the adenosine deaminase comprises TadA, TadA7.10, or a variant thereof. In some embodiments, the polypeptide further comprises a Uracil DNA glycosylase inhibitor (UGI) domain. In some embodiments, the nucleobase editor polypeptide comprises two UGIs. In some embodiments, the nucleobase editor polypeptide further comprises one or more Nuclear Localization Signals (NLS). In some embodiments, the NLS is a bipartite NLS. In some embodiments, the polypeptide comprises an N-terminal NLS and a C-terminal NLS. In some embodiments, the dCas domain binds a canonical PAM sequence and the nCas domain binds a non-canonical PAM sequence. In some embodiments, the nCas domain binds a canonical PAM sequence and the dCas domain bind a non-canonical PAM sequence. In some embodiments, the nCas binds a non-canonical PAM sequence of Tables 1-5. In some embodiments, the dCas binds a non-canonical PAM sequence of Tables 1-5. In some embodiments, the first and the second napDNAbp are selected from the group consisting of Cas12a, Cas12b, Cas12c, Cas12d, Cas12e, Cas12g, Cas12h, and Cas12i or functional fragments thereof. In some embodiments, the first napDNAbp comprises a gRNA binding domain of Cas9. In some embodiments, the first napDNAbp is a dCas9 domain incapable of cleaving a target nucleic acid sequence or the reverse complement strand of the target nucleic acid sequence. In some embodiments, the second napDNAbp comprises a DNA cleavage subdomain of Cas9. In some embodiments, the second napDNAbp is a nCas9 domain capable of cleaving a target nucleic acid sequence or the reverse complement strand of the target nucleic acid sequence. In some embodiments, the first or second napDNAbp domain is derived from Cas12a, Cas12b, Cas12c, Cas12d, Cas12e, Cas12g, Cas12h, or Cas12i. In some embodiments, the first napDNAbp domain is a dCas9 of *S. pyogenes* (dSpCas9), wherein the second napDNAbp domain is anCas9 of *S. aureus* (nSaCas9), wherein the dspCas9 and the nSaCas9 are joined by a linker, and wherein the domain having base editing activity is immediately adjacent to the first napDNAbp domain.

In some aspects, provided herein is one or more polynucleotides encoding the nucleobase editor described herein or the nucleobase editor polypeptide described herein. In some aspects, provided herein is one or more expression vectors comprising the one or more polynucleotides described herein.

In some aspects, provided herein is a nucleobase editor system comprising (a) a first napDNAbp domain or a functional fragment thereof that lacks nuclease activity and has nucleic acid sequence specific binding activity, (b) a second napDNAbp domain or a functional fragment thereof that has nickase activity and nucleic acid sequence specific binding activity, and (c) a domain having base editing activity or a functional fragment thereof, wherein the first napDNAbp domain is complexed with a first guide RNA, wherein the second napDNAbp domain is complexed with a second guide RNA, wherein the first napDNAbp and the second napDNAbp are heterologous, and wherein the first guide RNA and the second guide RNA are different.

In some embodiments, the first napDNAbp domain is a catalytically inactive CRISPR-Cas (dCas) or a fragment thereof. In some embodiments, the second napDNAbp domain is a CRISPR-Cas nickase (nCas) or a functional fragment thereof. In some embodiments, the domain having base editing activity is a cytidine deaminase domain or an adenosine deaminase domain. In some embodiments, the cytidine deaminase is *Petromyzon marinus* cytosine deaminase 1 (pCDM), or Activation-induced cytidine deaminase (AICDA). In some embodiments, the adenosine deaminase comprises TadA, TadA7.10, or a variant thereof. In some embodiments, the first or the second napDNAbp is fused to a Uracil DNA glycosylase inhibitor (UGI) domain. In some embodiments, the nucleobase editor system comprises two UGIs. In some embodiments, the first or the second napD- NAbp is fused with one or more Nuclear Localization Signals (NLS). In some embodiments, the NLS is a bipartite NLS. In some embodiments, the first napDNAbp is a dCas and wherein the second napDNAbp is a nCas, and wherein the dCas domain binds a canonical PAM sequence and the nCas domain binds a non-canonical PAM sequence. In some embodiments, the first napDNAbp is a dCas and wherein the second napDNAbp is a nCas, and wherein the nCas domain binds a canonical PAM sequence and the dCas domain binds a non-canonical PAM sequence. In some embodiments, the nCas binds a non-canonical PAM sequence of Tables 1-5. In some embodiments, the dCas binds a non-canonical PAM sequence of Tables 1-5. In some embodiments, the first and the second napDNAbp are selected from the group consisting of Cas12a, Cas12b, Cas12c, Cas12d, Cas12e, Cas12g, Cas12h, and Cas12i or functional fragments thereof. In some embodiments, the first napDNAbp comprises a gRNA binding domain of Cas9. In some embodiments, the first napDNAbp is a dCas9 domain incapable of cleaving a target nucleic acid sequence or the reverse complement strand of the target nucleic acid sequence. In some embodiments, the second napDNAbp comprises a DNA cleavage subdomain of Cas9. In some embodiments, the second napDNAbp is a nCas9 domain capable of cleaving a target nucleic acid sequence or the reverse complement strand of the target nucleic acid sequence. In some embodiments, the first or second napDNAbp domain is derived from Cas12a, Cas12b, Cas12c, Cas12d, Cas12e, Cas12g, Cas12h, or Cas12i. In some embodiments, the first napDNAbp domain is a dCas9 of S. pyogenes (dSpCas9), wherein the second napDNAbp domain is a nCas9 of S. aureus (nSaCas9), wherein the dspCas9 and the nSaCas9 are joined by a linker, and wherein the domain having base editing activity is immediately adjacent to the first napDNAbp domain.

In some aspects, provided herein is a nucleobase editor system comprising one or more polynucleotides encoding (a), (b), (c), and the first and second guide RNAs described herein. In some aspects, provided herein is a nucleobase editor system comprising one or more vectors comprising the one or more polynucleotides described herein. In some embodiments, the first napDNAbp and the second napDNAbp are joined by a linker. In some embodiments, the first napDNAbp and the second napDNAbp are expressed as separate proteins.

In some aspects, provided herein, is a method for editing a target polynucleotide, the method comprising contacting a target polynucleotide with (a) a first napDNAbp domain or a functional fragment thereof that lacks nuclease activity and has nucleic acid sequence specific binding activity, or a first polynucleotide that encodes the first napDNAbp, (b) a second napDNAbp domain or a functional fragment thereof that has nickase activity and nucleic acid sequence specific binding activity, or a second polynucleotide that encodes the second napDNAbp, (c) a domain having base editing activity or an functional fragment thereof, or a polynucleotide that encodes the domain having base editing activity, (d) a first guide RNA that binds nCas or a polynucleotide that encodes the first guide RNA, and a second guide RNA that binds dCas or a polynucleotide that encodes the second guide RNA, thereby editing the target polynucleotide, wherein the first napDNAbp domain is complexed with a first guide RNA, wherein the second napDNAbp domain is complexed with a second guide RNA, and wherein the first napDNAbp and the second napDNAbp are heterologous, and wherein the first guide RNA and the second guide RNA are different.

In some embodiments, the target polynucleotide is in a genome and wherein the editing of the target polynucleotide results in reduced indel formation in the genome compared to editing by contacting the target polynucleotide with the first guide RNA, (a) and (c) or contacting the target polynucleotide with the second guide RNA, (b) and (c). In some embodiments, the first napDNAbp domain is a catalytically inactive CRISPR-Cas (dCas) or a fragment thereof. In some embodiments, the second napDNAbp domain is a CRISPR-Cas nickase (nCas) or a functional fragment thereof. In some embodiments, the first napDNAbp domain is a catalytically inactive CRISPR-Cas (dCas) or a fragment thereof and wherein the second napDNAbp domain is a CRISPR-Cas nickase (nCas) or a functional fragment thereof. In some embodiments, the dCas domain binds a canonical PAM sequence and the nCas domain binds a non-canonical PAM sequence. In some embodiments, the nCas domain binds a canonical PAM sequence and the dCas domain binds a non-canonical PAM sequence. In some embodiments, the nCas binds a non-canonical PAM sequence of Tables 1-5. In some embodiments, the dCas binds a non-canonical PAM sequence of Tables 1-5. In some embodiments, the first and the second napDNAbp are selected from the group consisting of Cas12a, Cas12b, Cas12c, Cas12d, Cas12e, Cas12g, Cas12h, and Cas12i or functional fragments thereof. In some embodiments, the first napDNAbp is a dCas9 domain incapable of cleaving a target nucleic acid sequence or the reverse complement strand of the target nucleic acid sequence and wherein the second napDNAbp a nCas9 domain capable of cleaving a target nucleic acid sequence or the reverse complement strand of the target nucleic acid sequence. In some embodiments, the first or second napDNAbp domain is derived from Cas12a, Cas12b, Cas12c, Cas12d, Cas12e, Cas12g, Cas12h, or Cas12i. In some embodiments, the first napDNAbp domain is a dCas9 of S. pyogenes (dSpCas9), wherein the second napDNAbp domain is a nCas9 of S. aureus (nSaCas9), wherein the dspCas9 and the nSaCas9 are joined by a linker, and wherein the domain having base editing activity is immediately adjacent to the first napDNAbp domain. In some embodiments, the domain having base editing activity is a cytidine deaminase domain or an adenosine deaminase domain. In some embodiments, the cytidine deaminase is Petromyzon marinus cytosine deaminase 1 (pCDM), or Activation-induced cytidine deaminase (AICDA). In some embodiments, the adenosine deaminase comprises TadA, TadA7.10, or a variant thereof. In some embodiments, the first or the second napDNAbp is fused to a Uracil DNA glycosylase inhibitor (UGI) domain. In some embodiments, the method comprises two UGIs. In some embodiments, the first or the second napDNAbp is fused with one or more Nuclear Localization Signals (NLS). In some embodiments, the NLS is a bipartite NLS. In some embodiments, the contacting is via one or more vectors comprising the polynucleotides of (a), (b), (c), and (d). In some embodiments, the first napDNAbp and the second napDNAbp are joined by a linker. In some embodiments, the first napDNAbp and the second napDNAbp are expressed as separate proteins. In some embodiments, the editing results in an indel frequency of less than 1%. In some embodiments, the editing results in an indel frequency of less than 0.1%. In some embodiments, the target polynucleotide is present in a cell. In some embodiments, the target polynucleotide is present in the genome of an organism.

In some aspects, provided herein is a kit comprising a nucleobase editor comprising a first DNA binding protein domain that is catalytically inactive, a second DNA binding protein domain comprising nickase activity, and a domain comprising base editing activity, wherein the first DNA binding protein domain and the second DNA binding protein domain are heterologous. In some aspects, provided herein is a kit comprising a nucleobase editor polypeptide comprising a CRISPR-Cas domain having nickase activity (nCas), a catalytically inactive CRISPR-Cas domain lacking nickase activity (dCas), and a cytidine or adenosine deaminase domain, wherein the dCas domain and the nCas domains are joined by a linker, and the cytidine deaminase or adenosine deaminase domain is immediately adjacent to dCas, a first single guide RNA that binds nCas and a second single guide RNA that binds dCas.

Other features and advantages of the invention will be apparent from the detailed description, and from the claims.

DEFINITIONS

Figures 1A, 1B:
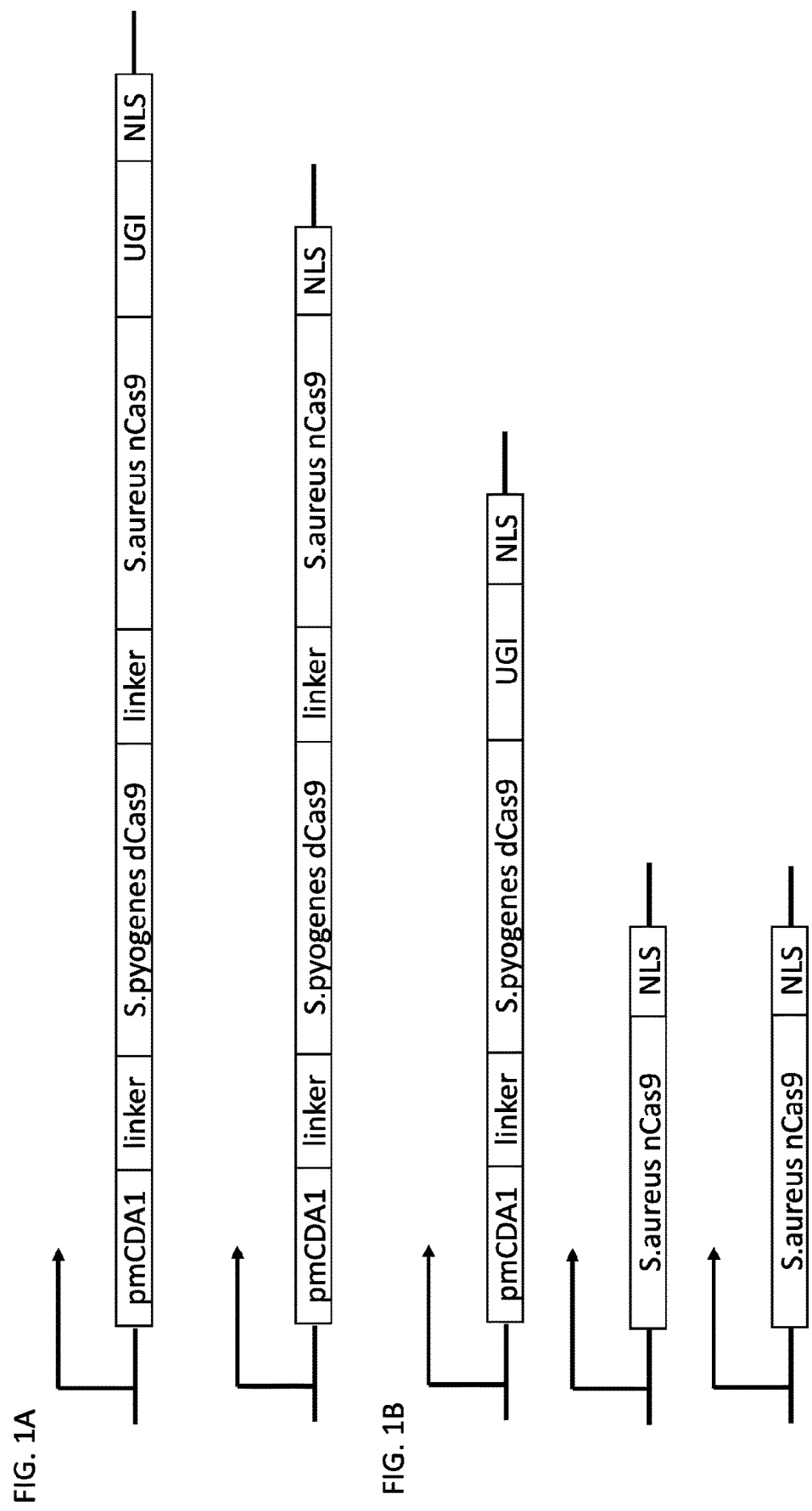
FIG. 1 shows schematic representations of base editor constructs for uncoupling of nicking from base editing in a base editor or base editing system (e.g., using a base editor comprising a dCas9 in combination with an nCas9 that nicks outside of region of dCas9 binding). A, constructs of pmCDA linked to dSpCas9 linked to nSaCas9 with or without UGI domain. B, constructs of pmCDA-dSpCas9 fusion expressed separately from nSaCas9. C, control constructs. C, constructs of TadA linked to dSpCas9 linked to nSaCas9. D, constructs of TadA-dSpCas9 fusion expressed separately from nSaCas9.
Figure 2A:
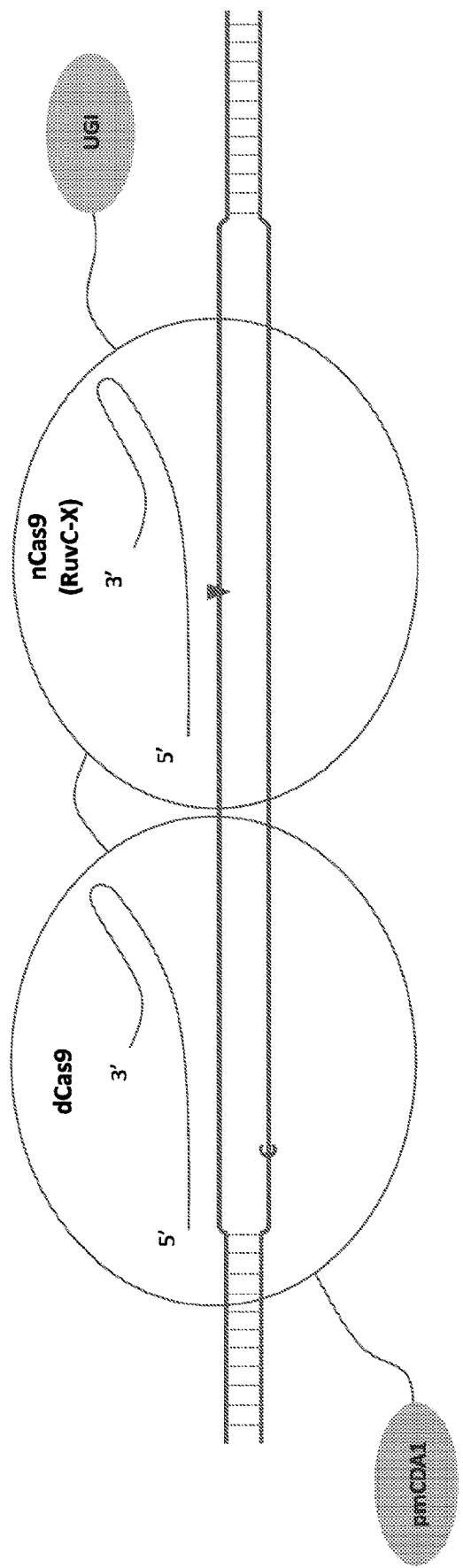
FIG. 2 illustrates double stranded DNA substrate binding by exemplary deaminase-dCas9: sgRNA-Cas9n:sgRNA complexes. It should be appreciated that the figures are not to be interpreted as drawn to scale. Each domain is as indicated in corresponding parts of the figures, where an "C" or "A" on one strand of the DNA indicates target nucleotide for deamination, a triangle indicates where a nick on the single DNA strand is created, and "X" indicates an inactivating mutation in corresponding subdomain of the Cas protein, e.g. RuvC or HNH subdomains.
Figure 2B:
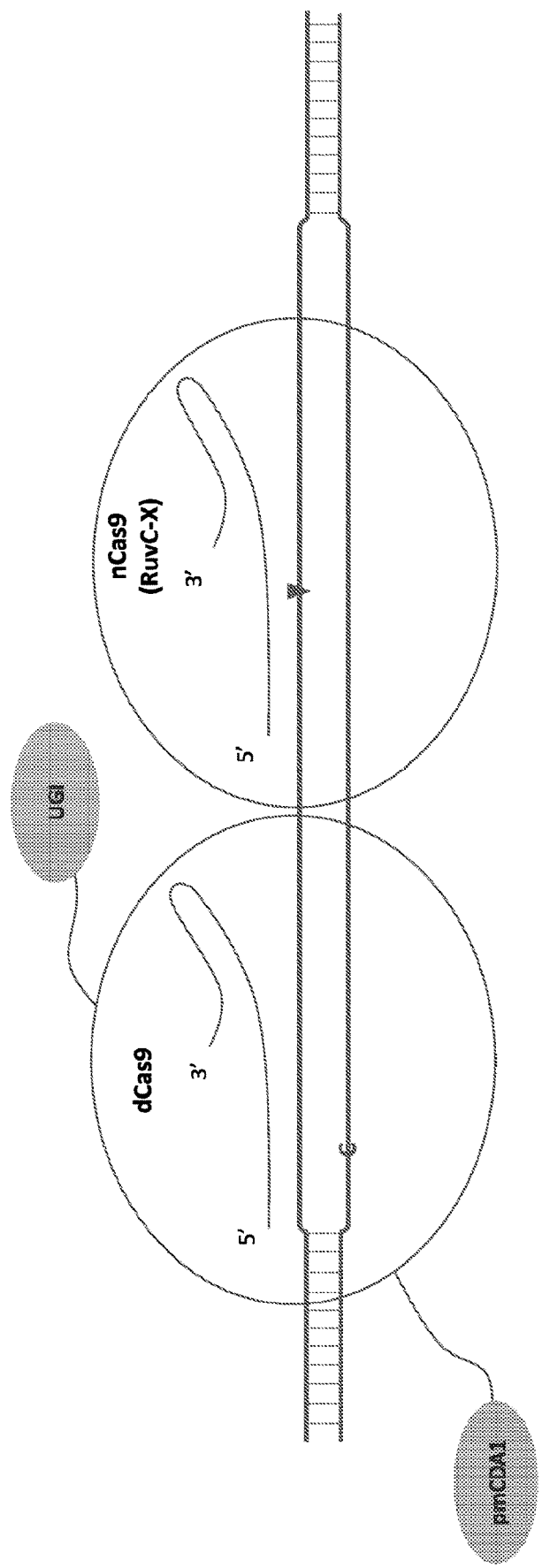
Figure 2C:
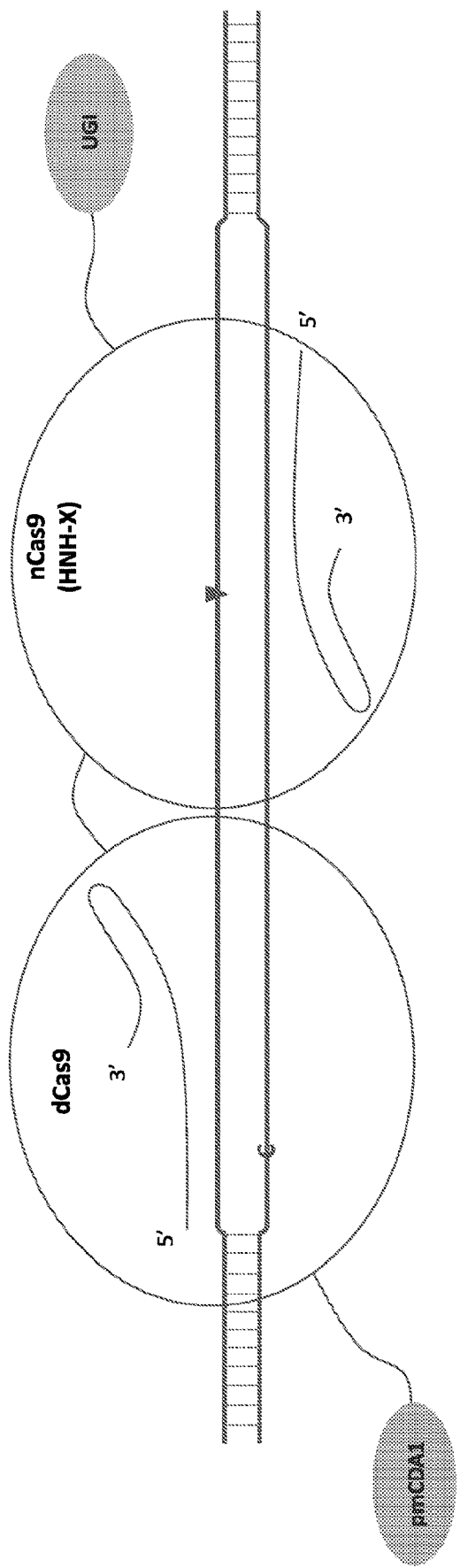
Figure 2D:
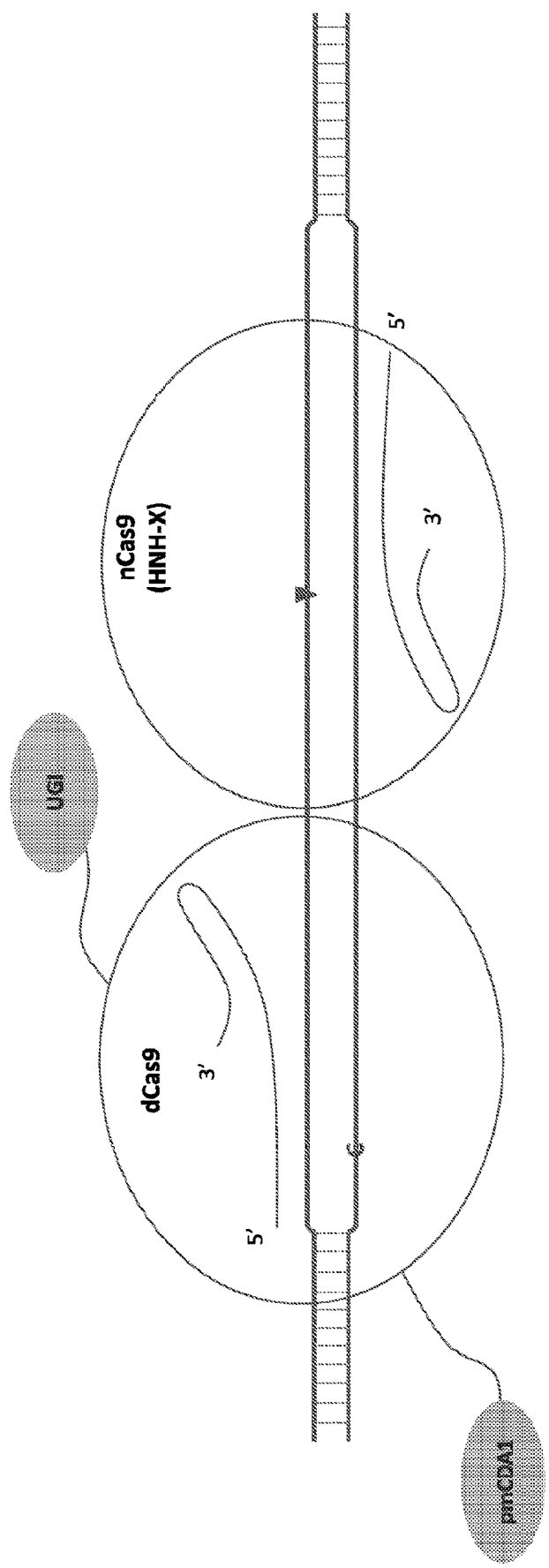
Figure 2E:
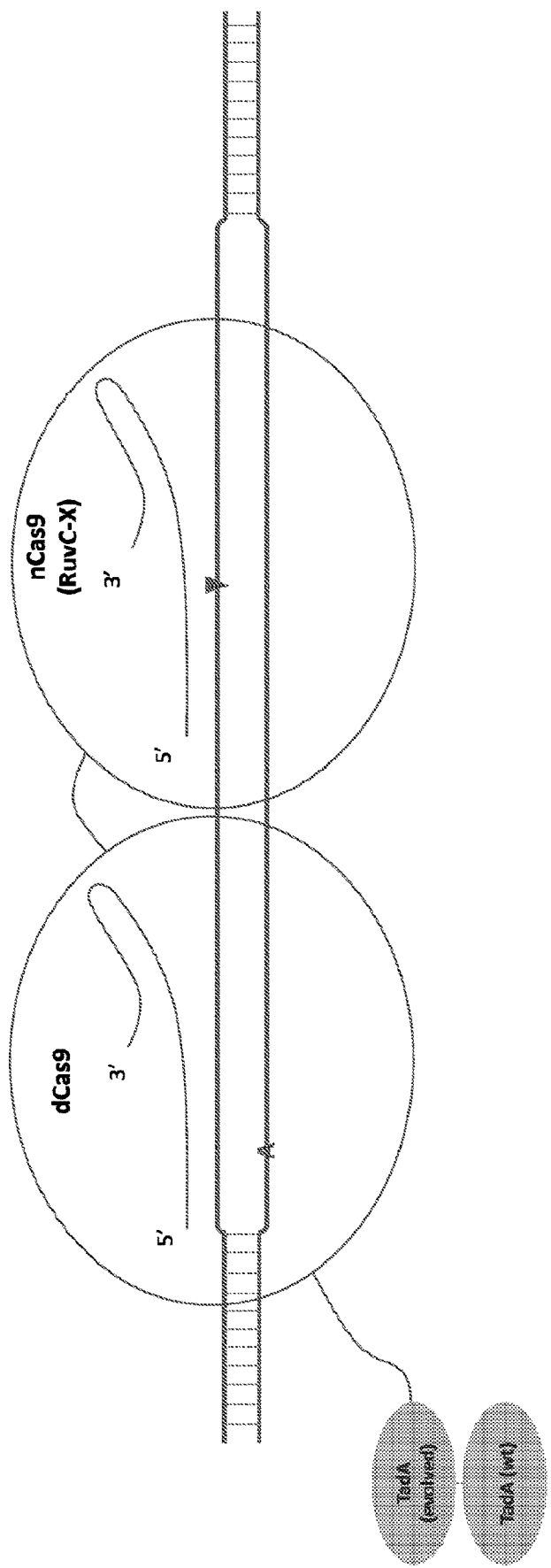
Figure 2F:
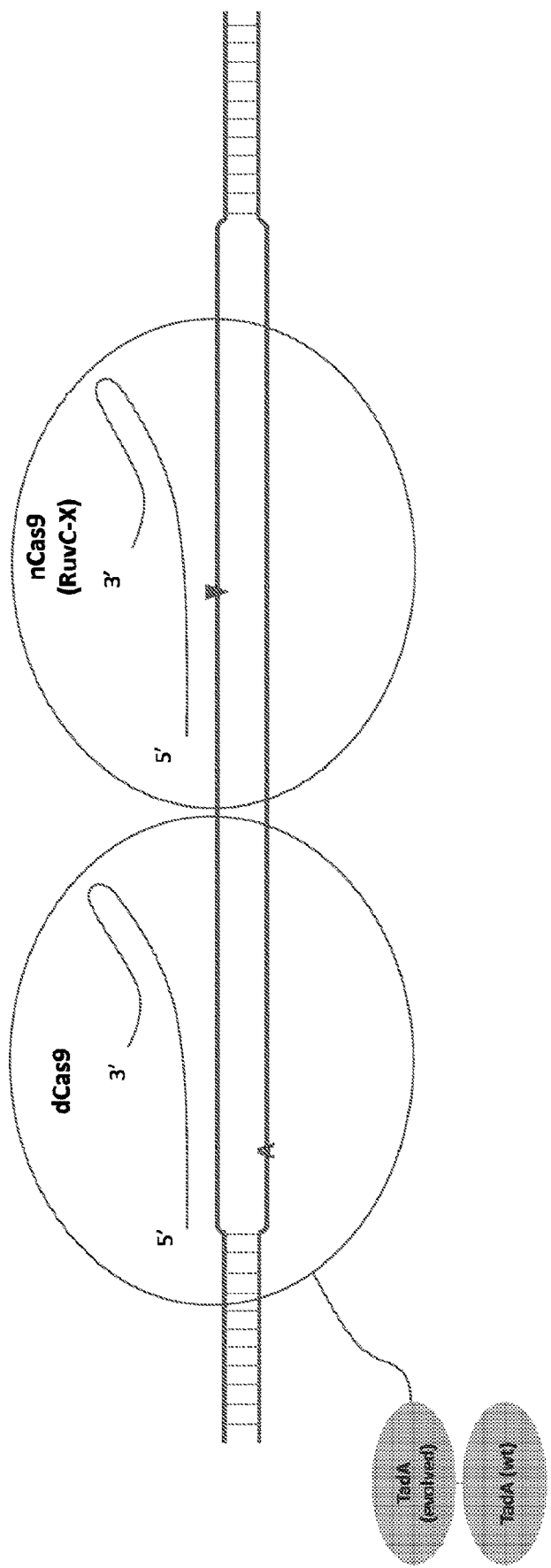
Figure 2G:
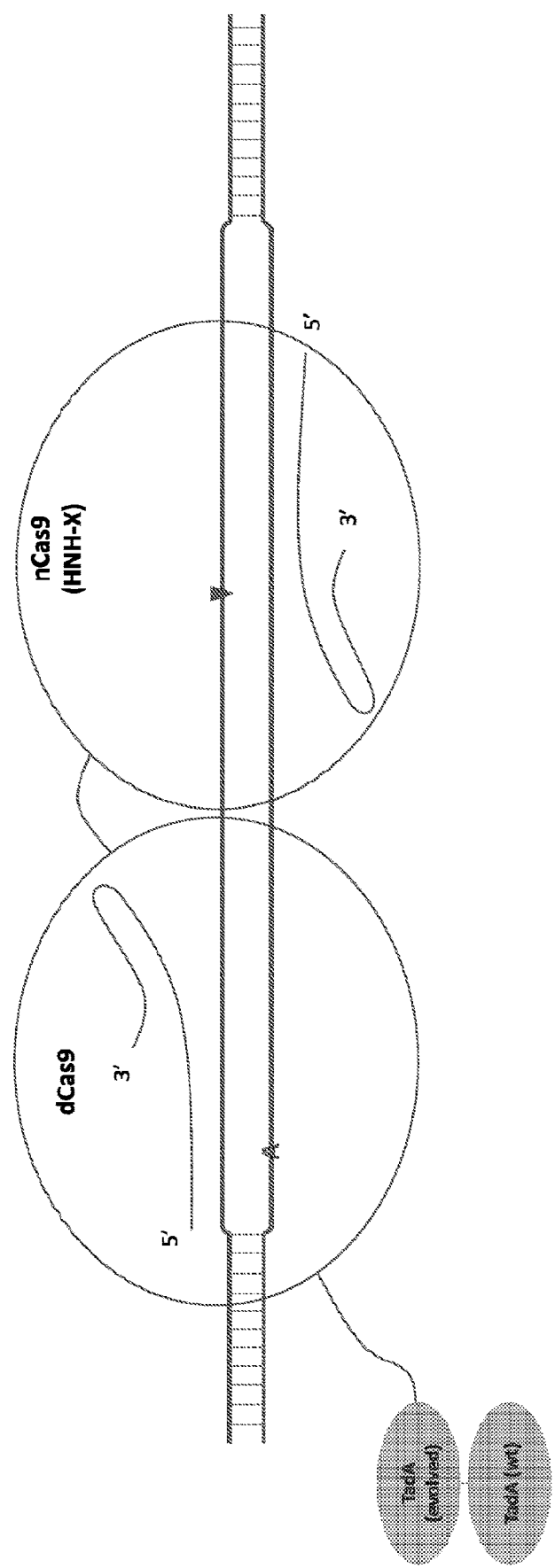
Figure 2H:
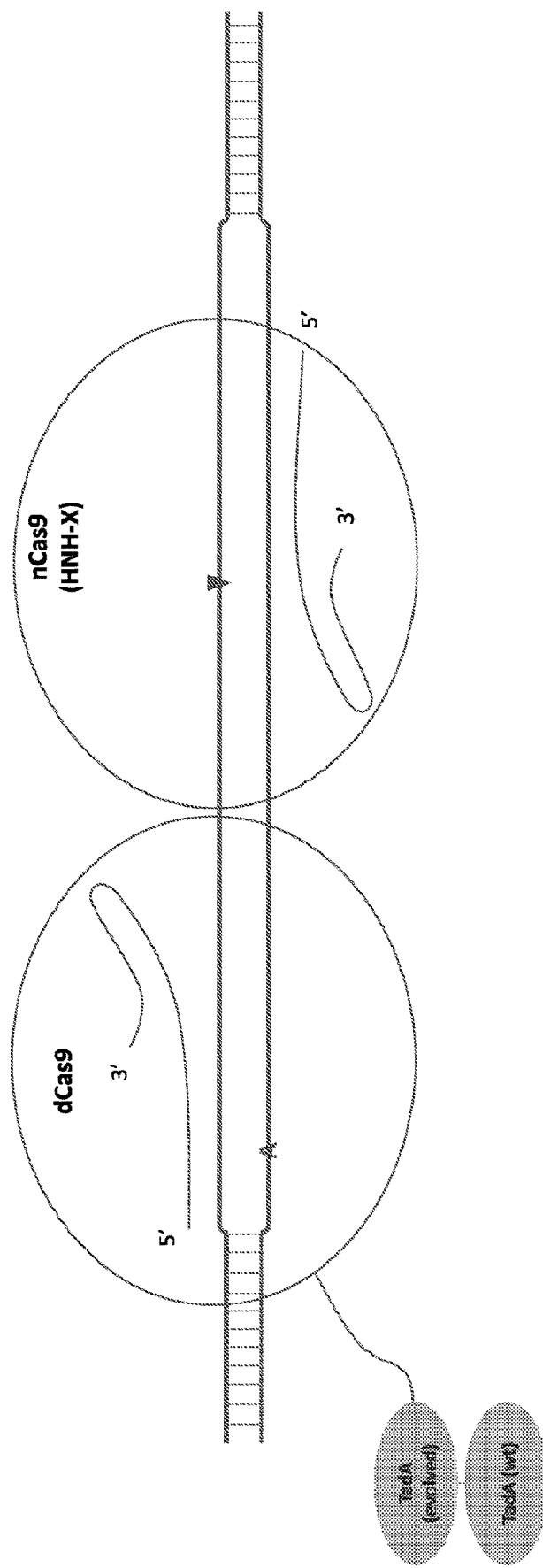

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, E. coli, S. aureus, S. typhi, S. putrefaciens, H. influenzae, or C. crescentus. In some embodiments, the adenosine deaminase is a TadA deaminase. In some embodiments, the TadA deaminase is an E. coli TadA (ecTadA) deaminase or a fragment thereof.

For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine. In some embodiments, the TadA deaminase is an N-terminal truncated TadA. In particular embodiments, the TadA is any one of the TadA described in PCT/US2017/045381, which is incorporated herein by reference in its entirety.

In certain embodiments, the adenosine deaminase comprises the amino acid sequence:

```
                                        (SEQ ID NO: 1)
MSEVEFSHEYWMRHALTLAKRAWDEREVPVGAVLVHNNRVIG

EGWNRPIGRHDPTAHAEIMALRQGGLVMQNYRLIDATLYVTL

EPCVMCAGAMIHSRIGRVVFGARDAKTGAAGSLMDVLHHPGM

NHRVEITEGILADECAALLSDFFRMRRQEIKAQKKAQSSTD,
``` which is termed "the TadA reference sequence".

In some embodiments the TadA deaminase is a full-length E. coli TadA deaminase. For example, in certain embodiments, the adenosine deaminase comprises the amino acid sequence:

```
                                        (SEQ ID NO: 2)
MRRAFITGVFFLSEVEFSHEYWMRHALTLAKRAWDEREVPV

GAVLVHNNRVIGEGWNRPIGRHDPTAHAEIMALRQGGLVMQ

NYRLIDATLYVTLEPCVMCAGAMIHSRIGRVVFGARDAKTG

AAGSLMDVLHHPGMNHRVEITEGILADECAALLSDFFRMRR

QEIKAQKKAQSSTD
```

It should be appreciated, however, that additional adenosine deaminases useful in the present application would be apparent to the skilled artisan and are within the scope of this disclosure. For example, the adenosine deaminase may be a homolog of adenosine deaminase acting on tRNA (AD AT). Exemplary AD AT homologs include, without limitation:

Staphylococcus aureus TadA:
(SEQ ID NO: 3)
MGSHMTNDIYFMTLAIEEAKKAAQLGEVPIGAIITKDDEVIA

RAHNLRETLQQPTAHAEHIAIERAAKVLGSWRLEGCTLYVTL

EPCVMCAGTIVMSRIPRVVYGADDPKGGCSGS LMNLLQQS

NFNHRAIVDKG VLKE AC S TLLTTFFKNLRANKKS TN

Bacillus subtilis TadA:
(SEQ ID NO: 4)
MTQDELYMKEAIKEAKKAEEKGEVPIGAVLVINGEIIARAH

NLRETEQRSIAHAEMLVIDEACKALGTWRLEGATLYVTLEP

CPMCAGAVVLSRVEKVVFGAFDPKGGC S GTLMN LLQE

ERFNHQAEVVSGVLEEECGGMLSAFFRELRKKKKAARKN

LSE

Salmonella typhimurium (S. typhimurium) TadA:
(SEQ ID NO: 5)
MPPAFITGVTSLSDVELDHEYWMRHALTLAKRAWDEREVPVG

AVLVHNHRVIGEGWNRPIGRHDPTAHAEIMALRQGGLVLQNY

RLLDTTLYVTLEPCVMCAGAMVHSRIGRVVFGARDAKTGAAG

SLIDVLHHPGMNHRVEIIEGVLRDECATLLSDFFRMRRQEIK

ALKKADRAEGAGPAV

Shewanella putrefaciens (S. putrefaciens) TadA:
(SEQ ID NO: 6)
MDE YWMQVAMQM AEKAEAAGE VPVGA VLVKDGQQ

IATGYNLS IS QHDPT AHAEI LCLRSAGKKLENYRLLDAT

LYITLEPCAMCAGAMVHSRIARVVYGARDEKTGAAGTVVN

LLQHPAFNHQVEVTSGVLAEACSAQLSRFFKRRRDEKKAL

KLAQRAQQGIE

Haemophilus influenzae F3031 (H. influenzae) TadA:
(SEQ ID NO: 7)
MDAAKVRSEFDEKMMRYALELADKAEALGEIPVGAVLVDDA

RNIIGEGWNLSIVQSDPT AH AEIIALRNG AKNIQN YR

LLNS TLY VTLEPCTMC AG AILHS RIKRLVFGAS D

YK TGAIGSRFHFFDDYKMNHTLEITSGVLAEECSQKLSTF

FQKRREEKKIEKALLKSLSDK

Caulobacter crescentus (C. crescentus) TadA:
(SEQ ID NO: 8)
MRTDESEDQDHRMMRLALDAARAAAEAGETPVGAVILDPST

GEVIATAGNGPIAAHDPTAHAEIAAMRAAAAKLGNYRLTDL

TLVVTLEPCAMCAGAISHARIGRVVFGADDPKGGAVVHGPK

FFAQPTCHWRPEVTGGVLADESADLLRGFFRARRKAKI

Geobacter sulfurreducens (G. sulfurreducens) TadA:
(SEQ ID NO: 9)
MSSLKKTPIRDDAYWMGKAIREAAKAAARDEVPIGAVIVRD

GAVIGRGHNLREGSNDPSAHAEMIAIRQAARRSANWRLTGA

TLYVTLEPCLMCMGAIILARLERVVFGCYDPKGGAAGSLYD

LSADPRLNHQVRLSPGVCQEECGTMLSDFFRDLRRRKKAKA

TPALFIDERKVPPEP

TadA7.10
(SEQ ID NO: 10)
MSEVEFSHEYWMRHALTLAKRARDEREVPVGAVLVLNNRVI

GEGWNRAIGLHDPTAHAEIMALRQGGLVMQNYRLIDATLYV

TFEPCVMCAGAMIHSRIGRVVFGVRNAKTGAAGSLMDVLHY

PGMNHRVEITEGILADECAALLCYFFRMPRQVFNAQKKAQS

STD

By "agent" is meant any small molecule chemical compound, antibody, nucleic acid molecule, or polypeptide, or fragments thereof.

By "alteration" is meant a change in the structure, expression levels or activity of a gene or polypeptide as detected by standard art known methods such as those described herein. As used herein, an alteration (e.g., increase or decrease) includes a 10% change in expression levels, a 25% change, a 40% change, and a 50% or greater change in expression levels.

By "analog" is meant a molecule that is not identical, but has analogous functional or structural features. For example, a polypeptide analog retains at least some of the biological activity of a corresponding naturally-occurring polypeptide, while having certain sequence modifications that enhance the analog's function relative to a naturally occurring polypeptide. Such modifications could increase the analog's protease resistance, membrane permeability, or half-life, without altering, for example, polynucleotide binding activity. In another example, a polynucleotide analog retains the biological activity of a corresponding naturally-occurring polynucleotide while having certain modifications that enhance the analog's function relative to a naturally occurring polynucleotide. Such modifications could increase the polynucleotide's affinity for DNA, half-life, and/or nuclease resistance, an analog may include an unnatural nucleotide or amino acid.

By "base editor (BE)," or "nucleobase editor (NBE)" is meant an agent that binds a polynucleotide and has nucleobase modifying activity. In various embodiments, the base editor comprises a nucleobase modifying polypeptide (e.g., a deaminase) and a polynucleotide programmable nucleotide binding domain in conjunction with a guide polynucleotide (e.g., guide RNA). In some embodiments, the base editor comprises a nucleobase modifying polypeptide (e.g. a deaminase) and at least two polynucleotide programmable nucleotide binding domain, in some embodiments, one of the two polynucleotide programmable nucleotide binding domains is in conjunction with a guide polynucleotide. In some embodiments, each polynucleotide programmable nucleotide binding domains is in conjunction with a separate guide polynucleotide (e.g., guide RNA). In some embodiments, the at least two polynucleotide programmable nucleotide binding domains are associated via a linker, e.g. a peptide linker, a non-peptide linker, or a polynucleotide linker. In some embodiments, the at least two polynucleotide programmable nucleotide binding domains are not associated via a linker. In various embodiments, the agent is a biomolecular complex comprising a protein domain having base editing activity, i.e., a domain capable of modifying a base (e.g., A, T, C, G, or U) within a nucleic acid molecule (e.g., DNA). In some embodiments, the polynucleotide programmable DNA binding domain is fused or linked to a deaminase domain. In one embodiment, the agent is a fusion protein comprising one or more domains having base editing activity. In another embodiment, the protein domains having base editing activity are linked to the guide RNA (e.g., via an RNA binding motif on the guide RNA and an RNA binding domain fused to the deaminase). In some embodiments, the domains having base editing activity are capable of deaminating a base within a nucleic acid molecule. In some embodiments, the base editor is capable of deaminating one or more bases within a DNA molecule. In some embodiments, the base editor is capable of deaminating a cytosine (C) or an adenosine (A) within DNA. In some embodiments, the base editor is capable of deaminating a cytosine (C) and an adenosine (A) within DNA. In some embodiments, the base editor is a cytidine base editor (CBE). In some embodiments, the base editor is an adenosine base editor (ABE). In some embodiments, the base editor is an adenosine base editor (ABE) and a cytidine base editor (CBE). In some embodiments, the base editor is a nuclease-inactive Cas9 (dCas9) fused to an adenosine deaminase. In some embodiments, the Cas9 is a circular permutant Cas9 (e.g., spCas9 or saCas9). Circular permutant Cas9s are known in the art and described, for example, in Oakes et al., Cell 176, 254-267, 2019. In some embodiments, the base editor is fused to an inhibitor of base excision repair, for example, a UGI domain, or a dISN domain. In some embodiments, the fusion protein comprises a Cas9 nickase fused to a deaminase and an inhibitor of base excision repair, such as a UGI or dISN domain. In other embodiments the base editor is an abasic base editor.

In some embodiments, an adenosine deaminase is evolved from TadA. In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. In some embodiments, the base editor is fused to an inhibitor of base excision repair (BER). In some embodiments, the inhibitor of base excision repair is a uracil DNA glycosylase inhibitor (UGI). In some embodiments, the inhibitor of base excision repair is an inosine base excision repair inhibitor. Details of base editors are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3: eaao4774 (2017), and Rees, H. A., et al., "Base editing: precision chemistry on the genome and transcriptome of living cells." Nat Rev Genet. 2018 December; 19 (12): 770-788. doi: 10.1038/s41576-018-0059-1, the entire contents of which are hereby incorporated by reference.

In some embodiments, base editors are generated by cloning an adenosine deaminase variant (e.g., TadA*7.10) into a scaffold that includes a circular permutant Cas9 (e.g., spCAS9) and a bipartite nuclear localization sequence. Circular permutant Cas9s are known in the art and described, for example, in Oakes et al., Cell 176, 254-267, 2019. Exemplary circular permutant sequences are set forth below, in which the bold sequence indicates sequence derived from Cas9, the italics sequence denotes a linker sequence, and the underlined sequence denotes a bipartite nuclear localization sequence. CP5 (with MSP "NGC=Pam Variant with mutations Regular Cas9 likes NGG" PID=Protein Interacting Domain and "D10A" nickase):

(SEQ ID NO: 11)
EIGKATAKYFFYSNIMNFFKTEITLANGEIRKRPL

IETNGETGEIVWDKGRDFATVRKVLSMPQVNIVKK

TEVQTGGFSKESILPKRNSDKLIARKKDWDPKKYG

GFMQPTVAYSVLVVAKVEKGKSKKLKSVKELLGIT

IMERSSFEKNPIDFLEAKGYKEVKKDLIIKLPKYS

LFELENGRKRMLASAKFLQKGNELALPSKYVNFLY

LASHYEKLKGSPEDNEQKQLFVEQHKHYLDEIIEQ

ISEFSKRVILADANLDKVLSAYNKHRDKPIREQAE

NIIHLFTLTNLGAPRAFKYFDTTIARKEYRSTKEV

LDATLIHQSITGLYETRIDLSQLGGD*GGSGGSGGS*

*GGSGGSGGSGGM*DKKYSIGLAIGTNSVGWAVITDE

YKVPSKKFKVLGNTDRHSIKKNLIGALLFDSGETA

EATRLKRTARRRYTRRKNRICYLQEIFSNEMAKVD

DSFFHRLEESFLVEEDKKHERHPIFGNIVDEVAYH

EKYPTIYHLRKKLVDSTDKADLRLIYLALAHMIKF

RGHFLIEGDLNPDNSDVDKLFIQLVQTYNQLFEEN

PINASGVDAKAILSARLSKSRRLENLIAQLPGEKK

NGLFGNLIALSLGLTPNFKSNFDLAEDAKLQLSKD

TYDDDLDNLLAQIGDQYADLFLAAKNLSDAILLSD

ILRVNTEITKAPLSASMIKRYDEHHQDLTLLKALV

RQQLPEKYKEIFFDQSKNGYAGYIDGGASQEEFYK

FIKPILEKMDGTEELLVKLNREDLLRKQRTFDNGS

IPHQIHLGELHAILRRQEDFYPFLKDNREKIEKIL

TFRIPYYVGPLARGNSRFAWMTRKSEETITPWNFE

EVVDKGASAQSFIERMTNFDKNLPNEKVLPKHSLL

YEYFTVYNELTKVKYVTEGMRKPAFLSGEQKKAIV

DLLFKTNRKVTVKQLKEDYFKKIECFDSVEISGVE

DRFNASLGTYHDLLKIIKDKDFLDNEENEDILEDI

VLTLTLFEDREMIEERLKTYAHLFDDKVMKQLKRR

RYTGWGRLSRKLINGIRDKQSGKTILDFLKSDGFA

NRNFMQLIHDDSLTFKEDIQKAQVSGQGDSLHEHI

ANLAGSPAIKKGILQTVKVVDELVKVMGRHKPENI

VIEMARENQTTQKGQKNSRERMKRIEEGIKELGSQ

ILKEHPVENTQLQNEKLYLYYLQNGRDMYVDQELD

INRLSDYDVDHIVPQSFLKDDSIDNKVLTRSDKNR

GKSDNVPSEEVVKKMKNYWRQLLNAKLITQRKFDN

LTKAERGGLSELDKAGFIKRQLVETRQITKHVAQI

```
LDSRMNTKYDENDKLIREVKVITLKSKLVSDFRKD

FQFYKVREINNYHHAHDAYLNAVVGTALIKKYPKL

ESEFVYGDYKVYDVRKMIAKSEQEGADKRTADGSE

FESPKKKRKV*
```

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

By "base editing activity" is meant acting to chemically alter a base within a polynucleotide. In one embodiment, a first base is converted to a second base. In another embodiment, a base is excised from a polynucleotide. In one embodiment, the base editing activity is cytidine deaminase activity, e.g., converting target C·G to T·A. In another embodiment, the base editing activity is adenine deaminase activity, e.g., converting A·T to G·C.

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems, correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. Single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., Mclaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607 (2011); and "A programmable dual-RNA-guided DNA endonuclease in adaptive bacterial immunity." Jinek M., Chylinski K., Fonfara I., Hauer M., Doudna J. A., Charpentier E. Science 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821 (2012); Qi et al., "Repurposing CRISPR as an RNA-Guided Platform for Sequence-Specific Control of Gene Expression" (2013) *Cell.* 28; 152 (5): 1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821 (2012); Qi et al., *Cell.* 28; 152 (5): 1173-83 (2013)). In some embodiments, a Cas9 nuclease has an inactive (e.g., an inactivated) DNA cleavage domain, that is, the Cas9 is a nickase, referred to as an "nCas9" protein (for "nickase" Cas9). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild type Cas9 corresponds to Cas9 from *Streptococcus pyogenes* (NCBI Reference Sequence: NC_017053.1, nucleotide and amino acid sequences as follows).

(SEQ ID NO: 12)
ATGGATAAGAAATACTCAATAGGCTTAGATATCGG

CACAAATAGCGTCGGATGGGCGGTGATCACTGATG

ATTATAAGGTTCCGTCTAAAAAGTTCAAGGTTCTG

GGAAATACAGACCGCCACAGTATCAAAAAAATCT

TATAGGGGCTCTTTTATTTGGCAGTGGAGAGACAG

CGGAAGCGACTCGTCTCAAACGGACAGCTCGTAGA

AGGTATACACGTCGGAAGAATCGTATTTGTTATCT

ACAGGAGATTTTTTCAAATGAGATGGCGAAAGTAG

ATGATAGTTTCTTTCATCGACTTGAAGAGTCTTTT

TTGGTGGAAGAAGACAAGAAGCATGAACGTCATCC

TATTTTTGGAAATATAGTAGATGAAGTTGCTTATC

ATGAGAAATATCCAACTATCTATCATCTGCGAAAA

AAATTGGCAGATTCTACTGATAAAGCGGATTTGCG

CTTAATCTATTTGGCCTTAGCGCATATGATTAAGT

TTCGTGGTCATTTTTTGATTGAGGGAGATTTAAAT

CCTGATAATAGTGATGTGGACAAACTATTTATCCA

GTTGGTACAAATCTACAATCAATTATTTGAAGAAA

ACCCTATTAACGCAAGTAGAGTAGATGCTAAAGCG

ATTCTTTCTGCACGATTGAGTAAATCAAGACGATT

AGAAAATCTCATTGCTCAGCTCCCCGGTGAGAAGA

GAAATGGCTTGTTTGGGAATCTCATTGCTTTGTCA

TTGGGATTGACCCCTAATTTTAAATCAAATTTTGA

TTTGGCAGAAGATGCTAAATTACAGCTTTCAAAAG

ATACTTACGATGATGATTTAGATAATTTATTGGCG

CAAATTGGAGATCAATATGCTGATTTGTTTTTGGC

AGCTAAGAATTTATCAGATGCTATTTTACTTTCAG

ATATCCTAAGAGTAAATAGTGAAATAACTAAGGCT

CCCCTATCAGCTTCAATGATTAAGCGCTACGATGA

ACATCATCAAGACTTGACTCTTTTAAAAGCTTTAG

TTCGACAACAACTTCCAGAAAAGTATAAAGAAATC

TTTTTTGATCAATCAAAAAACGGATATGCAGGTTA

TATTGATGGGGAGCTAGCCAAGAAGAATTTTATA

AATTTATCAAACCAATTTTAGAAAAAATGGATGGT

ACTGAGGAATTATTGGTGAAACTAAATCGTGAAGA

TTTGCTGCGCAAGCAACGGACCTTTGACAACGGCT

CTATTCCCCATCAAATTCACTTGGGTGAGCTGCAT

GCTATTTTGAGAAGACAAGAAGACTTTTATCCATT

TTTAAAAGACAATCGTGAGAAGATTGAAAAAATCT

TGACTTTTCGAATTCCTTATTATGTTGGTCCATTG

GCGCGTGGCAATAGTCGTTTTGCATGGATGACTCG

GAAGTCTGAAGAAACAATTACCCCATGGAATTTTG

AAGAAGTTGTCGATAAAGGTGCTTCAGCTCAATCA

TTTATTGAACGCATGACAAACTTTGATAAAAATCT

TCCAAATGAAAAAGTACTACCAAAACATAGTTTGC

TTTATGAGTATTTTACGGTTTATAACGAATTGACA

AAGGTCAAATATGTTACTGAGGGAATGCGAAAACC

AGCATTTCTTTCAGGTGAACAGAAGAAAGCCATTG

TTGATTTACTCTTCAAAACAAATCGAAAAGTAACC

GTTAAGCAATTAAAAGAAGATTATTTCAAAAAAAT

AGAATGTTTTGATAGTGTTGAAATTTCAGGAGTTG

AAGATAGATTTAATGCTTCATTAGGCGCCTACCAT

GATTTGCTAAAAATTATTAAAGATAAAGATtTTTT

GGATAATGAAGAAATGAAGATATCTTAGAGGATA

TTGTTTTAACATTGACCTTATTTGAAGATAGGGGG

ATGATTGAGGAAAGACTTAAAACATATGCTCACCT

CTTTGATGATAAGGTGATGAAACAGCTTAAACGTC

GCCGTTATACTGGTTGGGGACGTTTGTCTCGAAAA

TTGATTAATGGTATTAGGGATAAGCAATCTGGCAA

AACAATATTAGATTTTTTGAAATCAGATGGTTTTG

CCAATCGCAATTTTATGCAGCTGATCCATGATGAT

AGTTTGACATTTAAAGAAGATATTCAAAAAGCACA

GGTGTCTGGACAAGGCCATAGTTTACATGAACAGA

TTGCTAACTTAGCTGGCAGTCCTGCTATTAAAAAA

GGTATTTTACAGACTGTAAAAATTGTTGATGAACT

GGTCAAAGTAATGGGGCATAAGCCAGAAATATCG

TTATTGAAATGGCACGTGAAAATCAGACAACTCAA

AAGGGCCAGAAAAATTCGCGAGAGCGTATGAAACG

AATCGAAGAAGGTATCAAAGAATTAGGAAGTCAGA

TTCTTAAAGAGCATCCTGTTGAAAATACTCAATTG

CAAAATGAAAAGCTCTATCTCTATTATCTACAAAA

TGGAAGAGACATGTATGTGGACCAAGAATTAGATA

TTAATCGTTTAAGTGATTATGATGTCGATCACATT

GTTCCACAAAGTTTCATTAAAGACGATTCAATAGA

CAATAAGGTACTAACGCGTTCTGATAAAAATCGTG

GTAAATCGGATAACGTTCCAAGTGAAGAAGTAGTC

AAAAAGATGAAAAACTATTGGAGACAACTTCTAAA

CGCCAAGTTAATCACTCAACGTAAGTTTGATAATT

TAACGAAAGCTGAACGTGGAGGTTTGAGTGAACTT

-continued

GATAAAGCTGGTTTTATCAAACGCCAATTGGTTGA
AACTCGCCAAATCACTAAGCATGTGGCACAAATTT
TGGATAGTCGCATGAATACTAAATACGATGAAAAT
GATAAACTTATTCGAGAGGTTAAAGTGATTACCTT
AAAATCTAAATTAGTTTCTGACTTCCGAAAAGATT
TCCAATTCTATAAAGTACGTGAGATTAACAATTAC
CATCATGCCCATGATGCGTATCTAAATGCCGTCGT
TGGAACTGCTTTGATTAAGAAATATCCAAAACTTG
AATCGGAGTTTGTCTATGGTGATTATAAAGTTTAT
GATGTTCGTAAAATGATTGCTAAGTCTGAGCAAGA
AATAGGCAAAGCAACCGCAAAATATTTCTTTTACT
CTAATATCATGAACTTCTTCAAAACAGAAATTACA
CTTGCAAATGGAGAGATTCGCAAACGCCCTCTAAT
CGAAACTAATGGGGAAACTGGAGAAATTGTCTGGG
ATAAAGGGCGAGATTTTGCCACAGTGCGCAAAGTA
TTGTCCATGCCCCAAGTCAATATTGTCAAGAAAAC
AGAAGTACAGACAGGCGGATTCTCCAAGGAGTCAA
TTTTACCAAAAGAAATTCGGACAAGCTTATTGCT
CGTAAAAAAGACTGGGATCCAAAAAAATATGGTGG
TTTTGATAGTCCAACGGTAGCTTATTCAGTCCTAG
TGGTTGCTAAGGTGGAAAAAGGGAAATCGAAGAAG
TTAAAATCCGTTAAAGAGTTACTAGGGATCACAAT
TATGGAAGAAGTTCCTTTGAAAAAATCCGATTG
ACTTTTTAGAAGCTAAAGGATATAAGGAAGTTAAA
AAAGACTTAATCATTAAACTACCTAAATATAGTCT
TTTTGAGTTAGAAAACGGTCGTAAACGGATGCTGG
CTAGTGCCGGAGAATTACAAAAAGGAAATGAGCTG
GCTCTGCCAAGCAAATATGTGAATTTTTTATATTT
AGCTAGTCATTATGAAAAGTTGAAGGGTAGTCCAG
AAGATAACGAACAAAAACAATTGTTTGTGGAGCAG
CATAAGCATTATTTAGATGAGATTATTGAGCAAAT
CAGTGAATTTTCTAAGCGTGTTATTTTAGCAGATG
CCAATTTAGATAAAGTTCTTAGTGCATATAACAAA
CATAGAGACAAACCAATACGTGAACAAGCAGAAAA
TATTATTCATTTATTTACGTTGACGAATCTTGGAG
CTCCCGCTGCTTTTAAATATTTTGATACAACAATT
GATCGTAAACGATATACGTCTACAAAAGAAGTTTT
AGATGCCACTCTTATCCATCAATCCATCACTGGTC
TTTATGAAACACGCATTGATTTGAGTCAGCTAGGA
GGTGACTGA

-continued (SEQ ID NO: 13)
MDKK<u>YSIGLDIGTNSVGWAVITDDYKVPSKKFKVLG</u>
<u>NTDRHSIKKNLIGALLFGSGET</u>AEATRLKRTARRR
YTRRKNRICYLQEIFSNEMAKVDDSFFHRLEESFL
VEEDKKHERHPIFGNIVDEVAYHEKYPTIYHLRKK
LADSTDKADLRLIYLALAHMIKFRGHFLIEGDLNP
DNSDVDKLFIQLVQIYNQLFEENPINASRVDAKAI
LSARLSKSRRLENLIAQLPGEKRNGLFGNLIALSL
GLTPNFKSNFDLAEDAKLQLSKDTYDDDLDNLLAQ
IGDQYADLFLAAKNLSDAILLSDILRVNSEITKAP
LSASMIKRYDEHHQDLTLLKALVRQQLPEKYKEIF
FDQSKNGYAGYIDGGASQEEFYKFIKPILEKMDGT
EELLVKLNREDLLRKQRTFDNGSIPHQIHLGELHA
ILRRQEDFYPFLKDNREKIEKILTFRIPYYVGPLA
RGNSRFAWMTRKSEETITPWNFEEVVDKGASAQSF
IERMTNFDKNLPNEKVLPKHSLLYEYFTVYNELTK
VKYVTEGMRKPAFLSGEQKKAIVDLLFKTNRKVTV
KQLKEDYFKKIECFDSVEISGVEDRFNASLGAYHD
LLKIIKDKDFLDNEENEDILEDIVLTLTLFEDRGM
IEERLKTYAHLFDDKVMKQLKRRRYTGWGRLSRKL
INGIRDKQSGKTILDFLKSDGFANRNFMQLIHDDS
LTFKEDIQKAQVSGQG<u>HSLHEQIANLAGSPAIKKG</u>
<u>ILQTVKIVDELVKVMGHKPENIVIEMARENQTTQK</u>
<u>GQKNSRERMKRIEEGIKELGSQILKEHPVENTQLQ</u>
<u>NEKLYLYYLQNGRDMYVDQELDINRLSDYDVDHIV</u>
<u>PQSFIKDDSIDNKVLTRSDKNRGKSDNVPSEEVVK</u>
<u>KMKNYWRQLLNAKLITQRKFDNLTKAERGGLSELD</u>
<u>KAGFIKRQLVETRQITKHVAQILDSRMNTKYDEND</u>
<u>KLIREVKVITLKSKLVSDFRKDFQFYKVREINNYH</u>
<u>HAHDAYLNAVVGTALIKKYPKLESEFVYGDYKVYD</u>
<u>VRKMIAKSEQEIGKATAKYFFYSNIMNFFKTEITL</u>
<u>ANGEIRKRPLIETNGETGEIVWDKGRDFATVRKVL</u>
<u>SMPQVNIVKKTEVQTGGFSKESILPKRNSDKLIAR</u>
KKDWDPKKYGGFDSPTVAYSVLVVAKVEKGKSKKL
KSVKELLGITIMERSSFEKNPIDFLEAKGYKEVVK
DLIIKLPKYSLFELENGRKRMLASAGELQKGNELA
LPSKYVNFLYLASHYEKLKGSPEDNEQKQLFVEQH
KHYLDEIIEQISEFSKRVILADANLDKVLSAYNKH -continued

RDKPIREQAENIIHLFTLTNLGAPAAFKYFDTTID

RKRYTSTKEVLDATLIHQSITGLYETRIDLSQLGG

D (single underline: HNH domain;
double underline: RuvC domain)

In some embodiments, wild type Cas9 corresponds to, or comprises the following nucleotide and/or amino acid sequences:

(SEQ ID NO: 14)
ATGGATAAAAAGTATTCTATTGGTTTAGACATCGGC

ACTAATTCCGTTGGATGGGCTGTCATAACCGATGA

ATACAAAGTACCTTCAAAGAAATTTAAGGTGTTGG

GGAACACAGACCGTCATTCGATTAAAAAGAATCTT

ATCGGTGCCCTCCTATTCGATAGTGGCGAAACGGC

AGAGGCGACTCGCCTGAAACGAACCGCTCGGAGAA

GGTATACACGTCGCAAGAACCGAATATGTTACTTA

CAAGAAATTTTTAGCAATGAGATGGCCAAAGTTGA

CGATTCTTTCTTTCACCGTTTGGAAGAGTCCTTCC

TTGTCGAAGAGGACAAGAAACATGAACGGCACCCC

ATCTTTGGAAACATAGTAGATGAGGTGGCATATCA

TGAAAAGTACCCAACGATTTATCACCTCAGAAAAA

AGCTAGTTGACTCAACTGATAAAGCGGACCTGAGG

TTAATCTACTTGGCTCTTGCCCATATGATAAAGTT

CCGTGGGCACTTTCTCATTGAGGGTGATCTAAATC

CGGACAACTCGGATGTCGACAAACTGTTCATCCAG

TTAGTACAAACCTATAATCAGTTGTTTGAAGAGAA

CCCTATAAATGCAAGTGGCGTGGATGCGAAGGCTA

TTCTTAGCGCCCGCCTCTCTAAATCCCGACGGCTA

GAAAACCTGATCGCACAATTACCCGGAGAGAAGAA

AAATGGGTTGTTCGGTAACCTTATAGCGCTCTCAC

TAGGCCTGACACCAAATTTTAAGTCGAACTTCGAC

TTAGCTGAAGATGCCAAATTGCAGCTTAGTAAGGA

CACGTACGATGACGATCTCGACAATCTACTGGCAC

AAATTGGAGATCAGTATGCGGACTTATTTTTGGCT

GCCAAAAACCTTAGCGATGCAATCCTCCTATCTGA

CATACTGAGAGTTAATACTGAGATTACCAAGGCGC

CGTTATCCGCTTCAATGATCAAAAGGTACGATGAA

CATCACCAAGACTTGACACTTCTCAAGGCCCTAGT

CCGTCAGCAACTGCCTGAGAAATATAAGGAAATAT

TCTTTGATCAGTCGAAAAACGGGTACGCAGGTTAT

ATTGACGGCGGAGCGAGTCAAGAGGAATTCTACAA

GTTTATCAAACCCATATTAGAGAAGATGGATGGGA

-continued

CGGAAGAGTTGCTTGTAAAACTCAATCGCGAAGAT

CTACTGCGAAAGCAGCGGACTTTCGACAACGGTAG

CATTCCACATCAAATCCACTTAGGCGAATTGCATG

CTATACTTAGAAGGCAGGAGGATTTTTATCCGTTC

CTCAAAGACAATCGTGAAAAGATTGAGAAAATCCT

AACCTTTCGCATACCTTACTATGTGGGACCCCTGG

CCCGAGGGAACTCTCGGTTCGCATGGATGACAAGA

AAGTCCGAAGAAACGATTACTCCATGGAATTTTGA

GGAAGTTGTCGATAAAGGTGCGTCAGCTCAATCGT

TCATCGAGAGGATGACCAACTTTGACAAGAATTTA

CCGAACGAAAAGTATTGCCTAAGCACAGTTTACT

TTACGAGTATTTCACAGTGTACAATGAACTCACGA

AAGTTAAGTATGTCACTGAGGGCATGCGTAAACCC

GCCTTTCTAAGCGGAGAACAGAAGAAAGCAATAGT

AGATCTGTTATTCAAGACCAACCGCAAAGTGACAG

TTAAGCAATTGAAAGAGGACTACTTTAAGAAAATT

GAATGCTTCGATTCTGTCGAGATCTCCGGGGTAGA

AGATCGATTTAATGCGTCACTTGGTACGTATCATG

ACCTCCTAAAGATAATTAAAGATAAGGACTTCCTG

GATAACGAAGAGAATGAAGATATCTTAGAAGATAT

AGTGTTGACTCTTACCCTCTTTGAAGATCGGGAAA

TGATTGAGGAAAGACTAAAAACATACGCTCACCTG

TTCGACGATAAGGTTATGAAACAGTTAAAGAGGCG

TCGCTATACGGGCTGGGGACGATTGTCGCGGAAAC

TTATCAACGGGATAAGAGACAAGCAAAGTGGTAAA

ACTATTCTCGATTTTCTAAAGAGCGACGGCTTCGC

CAATAGGAACTTTATGCAGCTGATCCATGATGACT

CTTTAACCTTCAAAGAGGATATACAAAAGGCACAG

GTTTCCGGACAAGGGGACTCATTGCACGAACATAT

TGCGAATCTTGCTGGTTCGCCAGCCATCAAAAAGG

GCATACTCCAGACAGTCAAAGTAGTGGATGAGCTA

GTTAAGGTCATGGGACGTCACAAACCGGAAAACAT

TGTAATCGAGATGGCACGCGAAAATCAAACGACTC

AGAAGGGGCAAAAAAACAGTCGAGAGCGGATGAAG

AGAATAGAAGAGGGTATTAAAGAACTGGGCAGCCA

GATCTTAAAGGAGCATCCTGTGGAAAATACCCAAT

TGCAGAACGAGAAACTTTACCTCTATTACCTACAA

AATGGAAGGGACATGTATGTTGATCAGGAACTGGA

CATAAACCGTTTATCTGATTACGACGTCGATCACA

TTGTACCCCAATCCTTTTTGAAGGACGATTCAATC

```
GACAATAAAGTGCTTACACGCTCGGATAAGAACCG
AGGGAAAAGTGACAATGTTCCAAGCGAGGAAGTCG
TAAAGAAAATGAAGAACTATTGGCGGCAGCTCCTA
AATGCGAAACTGATAACGCAAAGAAAGTTCGATAA
CTTAACTAAAGCTGAGAGGGGTGGCTTGTCTGAAC
TTGACAAGGCCGGATTTATTAAACGTCAGCTCGTG
GAAACCCGCCAAATCACAAAGCATGTTGCACAGAT
ACTAGATTCCCGAATGAATACGAAATACGACGAGA
ACGATAAGCTGATTCGGGAAGTCAAAGTAATCACT
TTAAAGTCAAAATTGGTGTCGGACTTCAGAAAGGA
TTTTCAATTCTATAAAGTTAGGGAGATAAATAACT
ACCACCATGCGCACGACGCTTATCTTAATGCCGTC
GTAGGGACCGCACTCATTAAGAAATACCCGAAGCT
AGAAAGTGAGTTTGTGTATGGTGATTACAAAGTTT
ATGACGTCCGTAAGATGATCGCGAAAAGCGAACAG
GAGATAGGCAAGGCTACAGCCAAATACTTCTTTTA
TTCTAACATTATGAATTTCTTTAAGACGAAATCA
CTCTGGCAAACGGAGAGATACGCAAACGACCTTTA
ATTGAAACCAATGGGGAGACAGGTGAAATCGTATG
GGATAAGGGCCGGGACTTCGCGACGGTGAGAAAAG
TTTTGTCCATGCCCCAAGTCAACATAGTAAAGAAA
ACTGAGGTGCAGACCGGAGGGTTTTCAAAGGAATC
GATTCTTCCAAAAAGGAATAGTGATAAGCTCATCG
CTCGTAAAAAGGACTGGGACCCGAAAAAGTACGGT
GGCTTCGATAGCCCTACAGTTGCCTATTCTGTCCT
AGTAGTGGCAAAAGTTGAGAAGGGAAAATCCAAGA
AACTGAAGTCAGTCAAAGAATTATTGGGGATAACG
ATTATGGAGCGCTCGTCTTTTGAAAAGAACCCCAT
CGACTTCCTTGAGGCGAAAGGTTACAAGGAAGTAA
AAAAGGATCTCATAATTAAACTACCAAAGTATAGT
CTGTTTGAGTTAGAAAATGGCCGAAAACGGATGTT
GGCTAGCGCCGGAGAGCTTCAAAAGGGGAACGAAC
TCGCACTACCGTCTAAATACGTGAATTTCCTGTAT
TTAGCGTCCCATTACGAGAAGTTGAAAGGTTCACC
TGAAGATAACGAACAGAAGCAACTTTTTGTTGAGC
AGCACAAACATTATCTCGACGAAATCATAGAGCAA
ATTTCGGAATTCAGTAAGAGAGTCATCCTAGCTGA
TGCCAATCTGGACAAAGTATTAAGCGCATACAACA
AGCACAGGGATAAACCCATACGTGAGCAGGCGGAA
AATATTATCCATTTGTTTACTCTTACCAACCTCGG
CGCTCCAGCCGCATTCAAGTATTTTGACACAACGA
```

```
TAGATCGCAAACGATACACTTCTACCAAGGAGGTG
CTAGACGCGACACTGATTCACCAATCCATCACGGG
ATTATATGAAACTCGGATAGATTTGTCACAGCTTG
GGGGTGACGGATCCCCCAAGAAGAAGAGGAAAGTC
TCGAGCGACTACAAAGACCATGACGGTGATTATAA
AGATCATGACATCGATTACAAGGATGACGATGACA
AGGCTGCAGGA
```

(SEQ ID NO: 15)
MDKK<u>YSIGLDIGTNSVGWAVITDEYKVPSKKFKVL</u>
<u>GNTDRHSIKKNLIGALLFDSGETA</u>EATRLKRTARR
RYTRRKNRICYLQEIFSNEMAKVDDSFFHRLEESF
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDAKLQLSKDTYDDDLDNLLA
QIGDQYADLFLAAKNLSDAILLSDILRVNTEITKA
PLSASMIKRYDEHHQDLTLLKALVRQQLPEKYKEI
FFDQSKNGYAGYIDGGASQEEFYKFIKPILEKMDG
TEELLVKLNREDLLRKQRTFDNGSIPHQIHLGELH
AILRRQEDFYPFLKDNREKIEKILTFRIPYYVGPL
ARGNSRFAWMTRKSEETITPWNFEEVVDKGASAQS
FIERMTNFDKNLPNEKVLPKHSLLYEYFTVYNELT
KVKYVTEGMRKPAFLSGEQKKAIVDLLFKTNRKVT
VKQLKEDYFKKIECFDSVEISGVEDRFNASLGTYH
DLLKIIKDKDFLDNEENEDILEDIVLTLTLFEDRE
MIEERLKTYAHLFDDKVMKQLKRRRYTGWGRLSRK
LINGIRDKQSGKTILDFLKSDGFANRNFMQLIHDD
SLTFKEDIQKAQVSGQG<u>DSLHEHIANLAGSPAIKK</u>
<u>GILQTVKVVDELVKVMGRHKPENIVIEMA</u>RENQTT
QKGQKNSRERMKRIEEGIKELGSQILKEHPVENTQ
LQNEKLYLYYLQNGRDMYVDQELDINRLSDYDVDH
IVPQSFLKDDSIDNKVLTRSDKNRGKSDNVPSEEV
VKKMKNYWRQLLNAKLITQRKFDNLTKAERG<u>GLSE</u>
<u>LDKAGFIKRQLVETRQITKHVAQILDSRMNT</u>KYDE
NDKLIREVKVITLKSKLVSDFRKDFQFYKVREINN
YHHAHDAYLNAVVGTALIKKYPKLESEFVYGDYKV
YDVRKMIAKSEQEIGKATAKYFFYSNIMNFFKTEI
TLANGEIRKRPLIETNGETGEIVWDKGRDFATVRK
<u>VLSMPQVNIVKKTEVQTGGFSKESILPKRNSDKLI</u>
ARKKDWDPKKYGGFDSPTVAYSVLVVAKVEKGKSK

KLKSVKELLGITIMERSSFEKNPIDFLEAKGYKEV

KKDLIIKLPKYSLFELENGRKRMLASAGELQKGNE

LALPSKYVNFLYLASHYEKLKGSPEDNEQKQLFVE

QHKHYLDEIIEQISEFSKRVILADANLDKVLSAYN

KHRDKPIREQAENIIHLFTLTNLGAPAAFKYFDTT

IDRKRYTSTKEVLDATLIHQSITGLYETRIDLSQL

GGD
(single underline: HNH domain;
double underline: RuvC domain)

In some embodiments, wild type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows).

```
                              (SEQ ID NO: 16)
ATGGATAAGAAATACTCAATAGGCTTAGATATCGGC

ACAAATAGCGTCGGATGGGCGGTGATCACTGATGA

ATATAAGGTTCCGTCTAAAAAGTTCAAGGTTCTGG

GAAATACAGACCGCCACAGTATCAAAAAAATCTT

ATAGGGGCTCTTTTATTTGACAGTGGAGAGACAGC

GGAAGCGACTCGTCTCAAACGGACAGCTCGTAGAA

GGTATACACGTCGGAAGAATCGTATTTGTTATCTA

CAGGAGATTTTTTCAAATGAGATGGCGAAAGTAGA

TGATAGTTTCTTTCATCGACTTGAAGAGTCTTTTT

TGGTGGAAGAAGACAAGAAGCATGAACGTCATCCT

ATTTTTGGAAATATAGTAGATGAAGTTGCTTATCA

TGAGAAATATCCAACTATCTATCATCTGCGAAAAA

AATTGGTAGATTCTACTGATAAAGCGGATTTGCGC

TTAATCTATTTGGCCTTAGCGCATATGATTAAGTT

TCGTGGTCATTTTTTGATTGAGGGAGATTTAAATC

CTGATAATAGTGATGTGGACAAACTATTTATCCAG

TTGGTACAAACCTACAATCAATTATTTGAAGAAAA

CCCTATTAACGCAAGTGGAGTAGATGCTAAAGCGA

TTCTTTCTGCACGATTGAGTAAATCAAGACGATTA

GAAAATCTCATTGCTCAGCTCCCCGGTGAGAAGAA

AAATGGCTTATTTGGGAATCTCATTGCTTTGTCAT

TGGGTTTGACCCCTAATTTTAAATCAAATTTTGAT

TTGGCAGAAGATGCTAAATTACAGCTTTCAAAGA

TACTTACGATGATGATTTAGATAATTTATTGGCGC

AAATTGGAGATCAATATGCTGATTTGTTTTGGCA

GCTAAGAATTTATCAGATGCTATTTTACTTTCAGA

TATCCTAAGAGTAAATACTGAAATAACTAAGGCTC

CCCTATCAGCTTCAATGATTAAACGCTACGATGAA

CATCATCAAGACTTGACTCTTTTAAAAGCTTTAGT

TCGACAACAACTTCCAGAAAAGTATAAAGAAATCT

TTTTTGATCAATCAAAAAACGGATATGCAGGTTAT

ATTGATGGGGAGCTAGCCAAGAAGAATTTTATAA

ATTTATCAAACCAATTTTAGAAAAAATGGATGGTA

CTGAGGAATTATTGGTGAAACTAAATCGTGAAGAT

TTGCTGCGCAAGCAACGGACCTTTGACAACGGCTC

TATTCCCCATCAAATTCACTTGGGTGAGCTGCATG

CTATTTTGAGAAGACAAGAAGACTTTTATCCATTT

TTAAAAGACAATCGTGAGAAGATTGAAAAAATCTT

GACTTTTCGAATTCCTTATTATGTTGGTCCATTGG

CGCGTGGCAATAGTCGTTTTGCATGGATGACTCGG

AAGTCTGAAGAAACAATTACCCCATGGAATTTTGA

AGAAGTTGTCGATAAAGGTGCTTCAGCTCAATCAT

TTATTGAACGCATGACAAACTTTGATAAAAATCTT

CCAAATGAAAAGTACTACCAAAACATAGTTTGCT

TTATGAGTATTTTACGGTTTATAACGAATTGACAA

AGGTCAAATATGTTACTGAAGGAATGCGAAAACCA

GCATTTCTTTCAGGTGAACAGAAGAAAGCCATTGT

TGATTTACTCTTCAAAACAAATCGAAAAGTAACCG

TTAAGCAATTAAAAGAAGATTATTTCAAAAAAATA

GAATGTTTTGATAGTGTTGAAATTTCAGGAGTTGA

AGATAGATTTAATGCTTCATTAGGTACCTACCATG

ATTTGCTAAAAATTATTAAAGATAAAGATTTTTTG

GATAATGAAGAAAATGAAGATATCTTAGAGGATAT

TGTTTTAACATTGACCTTATTTGAAGATAGGGAGA

TGATTGAGGAAAGACTTAAAACATATGCTCACCTC

TTTGATGATAAGGTGATGAAACAGCTTAAACGTCG

CCGTTATACTGGTTGGGGACGTTTGTCTCGAAAAT

TGATTAATGGTATTAGGGATAAGCAATCTGGCAAA

ACAATATTAGATTTTTTGAAATCAGATGGTTTTGC

CAATCGCAATTTTATGCAGCTGATCCATGATGATA

GTTTGACATTTAAAGAAGACATTCAAAAAGCACAA

GTGTCTGGACAAGGCGATAGTTTACATGAACATAT

TGCAAATTTAGCTGGTAGCCCTGCTATTAAAAAAG

GTATTTTACAGACTGTAAAAGTTGTTGATGAATTG

GTCAAAGTAATGGGGCGGCATAAGCCAGAAAATAT

CGTTATTGAAATGGCACGTGAAAATCAGACAACTC

AAAAGGGCCAGAAAAATTCGCGAGAGCGTATGAAA

CGAATCGAAGAAGGTATCAAAGAATTAGGAAGTCA
```

```
GATTCTTAAAGAGCATCCTGTTGAAAATACTCAAT
TGCAAAATGAAAAGCTCTATCTCTATTATCTCCAA
AATGGAAGAGACATGTATGTGGACCAAGAATTAGA
TATTAATCGTTTAAGTGATTATGATGTCGATCACA
TTGTTCCACAAAGTTTCCTTAAAGACGATTCAATA
GACAATAAGGTCTTAACGCGTTCTGATAAAAATCG
TGGTAAATCGGATAACGTTCCAAGTGAAGAAGTAG
TCAAAAAGATGAAAAACTATTGGAGACAACTTCTA
AACGCCAAGTTAATCACTCAACGTAAGTTTGATAA
TTTAACGAAAGCTGAACGTGGAGGTTTGAGTGAAC
TTGATAAAGCTGGTTTTATCAAACGCCAATTGGTT
GAAACTCGCCAAATCACTAAGCATGTGGCACAAAT
TTTGGATAGTCGCATGAATACTAAATACGATGAAA
ATGATAAACTTATTCGAGAGGTTAAAGTGATTACC
TTAAAATCTAAATTAGTTTCTGACTTCCGAAAAGA
TTTCCAATTCTATAAAGTACGTGAGATTAACAATT
ACCATCATGCCCATGATGCGTATCTAAATGCCGTC
GTTGGAACTGCTTTGATTAAGAAATATCCAAAACT
TGAATCGGAGTTTGTCTATGGTGATTATAAAGTTT
ATGATGTTCGTAAAATGATTGCTAAGTCTGAGCAA
GAAATAGGCAAAGCAACCGCAAAATATTTCTTTTA
CTCTAATATCATGAACTTCTTCAAAACAGAAATTA
CACTTGCAAATGGAGAGATTCGCAAACGCCCTCTA
ATCGAAACTAATGGGGAAACTGGAGAAATTGTCTG
GGATAAAGGGCGAGATTTTGCCACAGTGCGCAAAG
TATTGTCCATGCCCCAAGTCAATATTGTCAAGAAA
ACAGAAGTACAGACAGGCGGATTCTCCAAGGAGTC
AATTTTACCAAAAAGAAATTCGGACAAGCTTATTG
CTCGTAAAAAGACTGGGATCCAAAAAAATATGGT
GGTTTTGATAGTCCAACGGTAGCTTATTCAGTCCT
AGTGGTTGCTAAGGTGGAAAAAGGGAAATCGAAGA
AGTTAAAATCCGTTAAAGAGTTACTAGGGATCACA
ATTATGAAAGAAGTTCCTTTGAAAAAAATCCGAT
TGACTTTTAGAAGCTAAAGGATATAAGGAAGTTA
AAAAAGACTTAATCATTAAACTACCTAAATATAGT
CTTTTTGAGTTAGAAAACGGTCGTAAACGGATGCT
GGCTAGTGCCGGAGAATTACAAAAAGGAAATGAGC
TGGCTCTGCCAAGCAAATATGTGAATTTTTTATAT
TTAGCTAGTCATTATGAAAAGTTGAAGGGTAGTCC
AGAAGATAACGAACAAAAACAATTGTTTGTGGAGC
AGCATAAGCATTATTTAGATGAGATTATTGAGCAA
ATCAGTGAATTTTCTAAGCGTGTTATTTTAGCAGA
TGCCAATTTAGATAAAGTTCTTAGTGCATATAACA
AACATAGAGACAAACCAATACGTGAACAAGCAGAA
AATATTATTCATTTATTTACGTTGACGAATCTTGG
AGCTCCCGCTGCTTTTAAATATTTTGATACAACAA
TTGATCGTAAACGATATACGTCTACAAAAGAAGTT
TTAGATGCCACTCTTATCCATCAATCCATCACTGG
TCTTTATGAAACACGCATTGATTTGAGTCAGCTAG
GAGGTGACTGA
```

(SEQ ID NO: 17)
MDKKYSIGLDIGTNSVGWAVITDEYKVPSKKFKVLG
NTDRHSIKKNLIGALLFDSGETAEATRLKRTARRR
YTRRKNRICYLQEIFSNEMAKVDDSFFHRLEESFL
VEEDKKHERHPIFGNIVDEVAYHEKYPTIYHLRKK
LVDSTDKADLRLIYLALAHMIKFRGHFLIEGDLNP
DNSDVDKLFIQLVQTYNQLFEENPINASGVDAKAI
LSARLSKSRRLENLIAQLPGEKKNGLFGNLIALSL
GLTPNFKSNFDLAEDAKLQLSKDTYDDDLDNLLAQ
IGDQYADLFLAAKNLSDAILLSDILRVNTEITKAP
LSASMIKRYDEHHQDLTLLKALVRQQLPEKYKEIF
FDQSKNGYAGYIDGGASQEEFYKFIKPILEKMDGT
EELLVKLNREDLLRKQRTFDNGSIPHQIHLGELHA
ILRRQEDFYPFLKDNREKIEKILTFRIPYYVGPLA
RGNSRFAWMTRKSEETITPWNFEEVVDKGASAQSF
IERMTNFDKNLPNEKVLPKHSLLYEYFTVYNELTK
VKYVTEGMRKPAFLSGEQKKAIVDLLFKTNRKVTV
KQLKEDYFKKIECFDSVEISGVEDRFNASLGTYHD
LLKIIKDKDFLDNEENEDILEDIVLTLTLFEDREM
IEERLKTYAHLFDDKVMKQLRRRYTGWGRLSRKL
INGIRDKQSGKTILDFLKSDGFANRNFMQLIHDDS
LTFKEDIQKAQVSGQGDSLHEHIANLAGSPAIKKG
ILQTVKVVDELVKVMGRHKPENIVIEMARENQTTQ
KGQKNSRERMKRIEEGIKELGSQILKEHPVENTQL
QNEKLYLYYLQNGRDMYVDQELDINRLSDYDVDHI
VPQSFLKDDSIDNKVLTRSDKNRGKSDNVPSEEVV
KKMKNYWRQLLNAKLITQRKFDNLTKAERGGLSEL
DKAGFIKRQLVETRQITKHVAQILDSRMNTKYDEN
DKLIREVKVITLKSKLVSDFRKDFQFYKVREINNY
HHAHDAYLNAVVGTALIKKYPKLESEFVYGDYKVY
DVRKMIAKSEQEIGKATAKYFFYSNIMNFFKTEIT

```
LANGEIRKRPLIETNGETGEIVWDKGRDFATVRKV

LSMPQVNIVKKTEVQTGGFSKESILPKRNSDKLIA

RKKDWDPKKYGGFDSPTVAYSVLVVAKVEKGKSKK

LKSVKELLGITIMERSSFEKNPIDFLEAKGYKEVK

KDLIIKLPKYSLFELENGRKRMLASAGELQKGNEL

ALPSKYVNFLYLASHYEKLKGSPEDNEQKQLFVEQ

HKHYLDEIIEQISEFSKRVILADANLDKVLSAYNK

HRDKPIREQAENIIHLFTLTNLGAPAAFKYFDTTI

DRKRYTSTKEVLDATLIHQSITGLYETRIDLSQLG

GD (single underline: HNH domain;
double underline: RuvC domain)
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis* I (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

```
                                    (SEQ ID NO: 18)
MDKKYSIGLAIGTNSVGWAVITDEYKVPSKKFKVLG

NTDRHSIKKNLIGALLFDSGETAEATRLKRTARRR

YTRRKNRICYLQEIFSNEMAKVDDSFFHRLEESFL

VEEDKKHERHPIFGNIVDEVAYHEKYPTIYHLRKK

LVDSTDKADLRLIYLALAHMIKFRGHFLIEGDLNP

DNSDVDKLFIQLVQTYNQLFEENPINASGVDAKAI

LSARLSKSRRLENLIAQLPGEKKNGLFGNLIALSL

GLTPNFKSNFDLAEDAKLQLSKDTYDDDLDNLLAQ

IGDQYADLFLAAKNLSDAILLSDILRVNTEITKAP

LSASMIKRYDEHHQDLTLLKALVRQQLPEKYKEIF

FDQSKNGYAGYIDGGASQEEFYKFIKPILEKMDGT

EELLVKLNREDLLRKQRTFDNGSIPHQIHLGELHA

ILRRQEDFYPFLKDNREKIEKILTFRIPYYVGPLA

RGNSRFAWMTRKSEETITPWNFEEVVDKGASAQSF

IERMTNFDKNLPNEKVLPKHSLLYEYFTVYNELTK

VKYVTEGMRKPAFLSGEQKKAIVDLLFKTNRKVTV

KQLKEDYFKKIECFDSVEISGVEDRFNASLGTYHD

LLKIIKDKDFLDNEENEDILEDIVLTLTLFEDREM

IEERLKTYAHLFDDKVMKQLKRRRYTGWGRLSRKL

INGIRDKQSGKTILDFLKSDGFANRNFMQLIHDDS

LTFKEDIQKAQVSGQGDSLHEHIANLAGSPAIKKG

ILQTVKVVDELVKVMGRHKPENIVIEMARENQTTQ

KGQKNSRERMKRIEEGIKELGSQILKEHPVENTQL

QNEKLYLYYLQNGRDMYVDQELDINRLSDYDVDAI

VPQSFLKDDSIDNKVLTRSDKNRGKSDNVPSEEVV

KKMKNYWRQLLNAKLITQRKFDNLTKAERGGLSEL

DKAGFIKRQLVETRQITKHVAQILDSRMNTKYDEN

DKLIREVKVITLKSKLVSDFRKDFQFYKVREINNY

HHAHDAYLNAVVGTALIKKYPKLESEFVYGDYKVY

DVRKMIAKSEQEIGKATAKYFFYSNIMNFFKTEIT

LANGEIRKRPLIETNGETGEIVWDKGRDFATVRKV

LSMPQVNIVKKTEVQTGGFSKESILPKRNSDKLIA

RKKDWDPKKYGGFDSPTVAYSVLVVAKVEKGKSKK

LKSVKELLGITIMERSSFEKNPIDFLEAKGYKEVK

KDLIIKLPKYSLFELENGRKRMLASAGELQKGNEL

ALPSKYVNFLYLASHYEKLKGSPEDNEQKQLFVEQ

HKHYLDEIIEQISEFSKRVILADANLDKVLSAYNK

HRDKPIREQAENIIHLFTLTNLGAPAAFKYFDTTI

DRKRYTSTKEVLDATLIHQSITGLYETRIDLSQLG

GD
(single underline: HNH domain;
double underline: RuvC domain).
```

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. In one embodiment, the fusion protein comprises two fragments of Cas9, one fragment having nickase activity and the other fragment having nucleic acid programmable DNA binding activity. For example, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all.

Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis* I (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria meningitidis* (NCBI Ref: YP_002342100.1).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9. In some embodiments, a fusion protein of the invention comprises nCas9 or a catalytically active fragment thereof and dCas9 or a fragment thereof having nucleic acid programmable DNA binding activity.

```
Exemplary catalytically inactive
Cas9 (dCas9):
                           (SEQ ID NO: 19)
DKKYSIGLAIGTNSVGWAVITDEYKVPSKKFKVLG

NTDRHSIKKNLIGALLFDSGETAEATRLKRTARRR

YTRRKNRICYLQEIFSNEMAKVDDSFFHRLEESFL

VEEDKKHERHPIFGNIVDEVAYHEKYPTIYHLRKK

LVDSTDKADLRLIYLALAHMIKFRGHFLIEGDLNP

DNSDVDKLFIQLVQTYNQLFEENPINASGVDAKAI

LSARLSKSRRLENLIAQLPGEKKNGLFGNLIALSL

GLTPNFKSNFDLAEDAKLQLSKDTYDDDLDNLLAQ

IGDQYADLFLAAKNLSDAILLSDILRVNTEITKAP

LSASMIKRYDEHHQDLTLLKALVRQQLPEKYKEIF

FDQSKNGYAGYIDGGASQEEFYKFIKPILEKMDGT

EELLVKLNREDLLRKQRTFDNGSIPHQIHLGELHA

ILRRQEDFYPFLKDNREKIEKILTFRIPYYVGPLA

RGNSRFAWMTRKSEETITPWNFEEVVDKGASAQSF

IERMTNFDKNLPNEKVLPKHSLLYEYFTVYNELTK

VKYVTEGMRKPAFLSGEQKKAIVDLLFKTNRKVTV

KQLKEDYFKKIECFDSVETSGVEDRFNASLGTYHD

LLKIIKDKDFLDNEENEDILEDIVLTLTLFEDREM

IEERLKTYAHLFDDKVMKQLKRRRYTGWGRLSRKL

INGIRDKQSGKTILDFLKSDGFANRNFMQLIHDDS

LTFKEDIQKAQVSGQGDSLHEHIANLAGSPAIKKG

ILQTVKVVDELVKVMGRHKPENIVIEMARENQTTQ

KGQKNSRERMKRIEEGIKELGSQILKEHPVENTQL

QNEKLYLYYLQNGRDMYVDQELDINRLSDYDVDAI

VPQSFLKDDSIDNKVLTRSDKNRGKSDNVPSEEVV

KKMKNYWRQLLNAKLITQRKFDNLTKAERGGLSEL

DKAGFIKRQLVETRQITKHVAQILDSRMNTKYDEN

DKLIREVKVITLKSKLVSDFRKDFQFYKVREINNY

HHAHDAYLNAVVGTALIKKYPKLESEFVYGDYKVY

DVRKMIAKSEQEIGKATAKYFFYSNIMNFFKTEIT

LANGEIRKRPLIETNGETGEIVWDKGRDFATVRKV

LSMPQVNIVKKTEVQTGGFSKESILPKRNSDKLIA

RKKDWDPKKYGGFDSPTVAYSVLVVAKVEKGKSKK

LKSVKELLGITIMERSSFEKNPIDFLEAKGYKEVK

KDLIIKLPKYSLFELENGRKRMLASAGELQKGNEL

ALPSKYVNFLYLASHYEKLKGSPEDNEQKQLFVEQ

HKHYLDEIIEQISEFSKRVILADANLDKVLSAYNK

HRDKPIREQAENIIHLFTLTNLGAPAAFKYFDTTI

DRKRYTSTKEVLDATLIHQSITGLYETRIDLSQLG

GD

Exemplary catalytically Cas9
nickase(nCas9):
                           (SEQ ID NO: 20)
DKKYSIGLAIGTNSVGWAVITDEYKVPSKKFKVLG

NTDRHSIKKNLIGALLFDSGETAEATRLKRTARRR

YTRRKNRICYLQEIFSNEMAKVDDSFFHRLEESFL

VEEDKKHERHPIFGNIVDEVAYHEKYPTIYHLRKK

LVDSTDKADLRLIYLALAHMIKFRGHFLIEGDLNP

DNSDVDKLFIQLVQTYNQLFEENPINASGVDAKAI

LSARLSKSRRLENLIAQLPGEKKNGLFGNLIALSL

GLTPNFKSNFDLAEDAKLQLSKDTYDDDLDNLLAQ

IGDQYADLFLAAKNLSDAILLSDILRVNTEITKAP
```

```
LSASMIKRYDEHHQDLTLLKALVRQQLPEKYKEIF

FDQSKNGYAGYIDGGASQEEFYKFIKPILEKMDGT

EELLVKLNREDLLRKQRTFDNGSIPHQIHLGELHA

ILRRQEDFYPFLKDNREKIEKILTFRIPYYVGPLA

RGNSRFAWMTRKSEETITPWNFEEVVDKGASAQSF

IERMTNFDKNLPNEKVLPKHSLLYEYFTVYNELTK

VKYVTEGIVIRKPAFLSGEQKKAIVDLLFKTNRKV

TVKQLKEDYFKKIECFDSVETSGVEDRFNASLGTY

HDLLKIIKDKDFLDNEENEDILEDIVLTLTLFEDR

EMIEERLKTYAHLFDDKVMKQLKRRRYTGWGRLSR

KLINGIRDKQSGKTILDFLKSDGFANRNFMQLIHD

DSLTFKEDIQKAQVSGQGDSLHEHIANLAGSPAIK

KGILQTVKVVDELVKVMGRHKPENIVIEMARENQT

TQKGQKNSRERMKRIEEGIKELGSQILKEHPVENT

QLQNEKLYLYYLQNGRDMYVDQELDINRLSDYDVD

HIVPQSFLKDDSIDNKVLTRSDKNRGKSDNVPSEE

VVKKMKNYWRQLLNAKLITQRKFDNLTKAERGGLS

ELDKAGFIKRQLVETRQITKHVAQILDSRMNTKYD

ENDKLIREVKVITLKSKLVSDFRKDFQFYKVREIN

NYHHAHDAYLNAVVGTALIKKYPKLESEFVYGDYK

VYDVRKMIAKSEQEIGKATAKYFFYSNIMNFFKTE

ITLANGEIRKRPLIETNGETGEIVWDKGRDFATVR

KVLSMPQVNIVKKTEVQTGGFSKESILPKRNSDKL

IARKKDWDPKKYGGFDSPTVAYSVLVVAKVEKGKS

KKLKSVKELLGITIIVIERSSFEKNPIDFLEAKGY

KEVKKDLIIKLPKYSLFELENGRKRMLASAGELQK

GNELALPSKYVNFLYLASHYEKLKGSPEDNEQKQL

FVEQHKHYLDEIIEQISEFSKRVILADANLDKVLS

AYNKHRDKPIREQAENIIHLFTLTNLGAPAAFKYF

DTTIDRKRYTSTKEVLDATLIHQSITGLYETRIDL

SQLGGD

Exemplary catalytically active Cas9:
                                (SEQ ID NO: 21)
DKKYSIGLDIGTNSVGWAVITDEYKVPSKKFKVLG

NTDRHSIKKNLIGALLFDSGETAEATRLKRTARRR

YTRRKNRICYLQEIFSNEMAKVDDSFFHRLEESFL

VEEDKKHERHPIFGNIVDEVAYHEKYPTIYHLRKK

LVDSTDKADLRLIYLALAHMIKFRGHFLIEGDLNP

DNSDVDKLFIQLVQTYNQLFEENPINASGVDAKAI

LSARLSKSRRLENLIAQLPGEKKNGLFGNLIALSL

GLTPNFKSNFDLAEDAKLQLSKDTYDDDLDNLLAQ

IGDQYADLFLAAKNLSDAILLSDILRVNTEITKAP

LSASMIKRYDEHHQDLTLLKALVRQQLPEKYKEIF

FDQSKNGYAGYIDGGASQEEFYKFIKPILEKMDGT

EELLVKLNREDLLRKQRTFDNGSIPHQIHLGELHA

ILRRQEDFYPFLKDNREKIEKILTFRIPYYVGPLA

RGNSRFAWMTRKSEETITPWNFEEVVDKGASAQSF

IERMTNFDKNLPNEKVLPKHSLLYEYFTVYNELTK

VKYVTEGIVIRKPAFLSGEQKKAIVDLLFKTNRKV

TVKQLKEDYFKKIECFDSVEISGVEDRFNASLGTY

HDLLKIIKDKDFLDNEENEDILEDIVLTLTLFEDR

EMIEERLKTYAHLFDDKVMKQLKRRRYTGWGRLSR

KLINGIRDKQSGKTILDFLKSDGFANRNFMQLIHD

DSLTFKEDIQKAQVSGQGDSLHEHIANLAGSPAIK

KGILQTVKVVDELVKVMGRHKPENIVIEMARENQT

TQKGQKNSRERMKRIEEGIKELGSQILKEHPVENT

QLQNEKLYLYYLQNGRDMYVDQELDINRLSDYDVD

HIVPQSFLKDDSIDNKVLTRSDKNRGKSDNVPSEE

VVKKMKNYWRQLLNAKLITQRKFDNLTKAERGGLS

ELDKAGFIKRQLVETRQITKHVAQILDSRMNTKYD

ENDKLIREVKVITLKSKLVSDFRKDFQFYKVREIN

NYHHAHDAYLNAVVGTALIKKYPKLESEFVYGDYK

VYDVRKMIAKSEQEIGKATAKYFFYSNIMNFFKTE

ITLANGEIRKRPLIETNGETGEIVWDKGRDFATVR

KVLSMPQVNIVKKTEVQTGGFSKESILPKRNSDKL

IARKKDWDPKKYGGFDSPTVAYSVLVVAKVEKGKS

KKLKSVKELLGITIIVIERSSFEKNPIDFLEAKGY

KEVKKDLIIKLPKYSLFELENGRKRMLASAGELQK

GNELALPSKYVNFLYLASHYEKLKGSPEDNEQKQL

FVEQHKHYLDEIIEQISEFSKRVILADANLDKVLS

AYNKHRDKPIREQAENIIHLFTLTNLGAPAAFKYF

DTTIDRKRYTSTKEVLDATLIHQSITGLYETRIDL

SQLGGD.
```

In some embodiments, Cas9 refers to a Cas9 from archaea (e.g. nanoarchaea), which constitute a domain and kingdom of single-celled prokaryotic microbes. In some embodiments, Cas protein refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napD-NAbp), and are within the scope of this disclosure.

In some embodiments, the napDNAbp is a Cas9 domain, for example a nuclease active Cas9, a Cas9 nickase (nCas9), or a nuclease inactive Cas9 (dCas9). Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" *CRISPR J.* 2018 October; 1:325-336. doi: 10.1089/crispr.2018.0033; Yan et al., "Functionally diverse type V CRISPR-Cas systems" *Science.* 2019 Jan. 4; 363 (6422): 88-91. doi: 10.1126/science.aav7271, the entire contents of each are hereby incorporated by reference.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

```
CasX (uniprot.org/uniprot/FONN87;
uniprot.org/uniprot/FONH53)
>tr|FONN87|FONN87_SULIH CRISPR-associated
Casx protein OS = Sulfolobus islandicus
(strain HVE10/4) GN = SiH_0402
PE = 4 SV = 1
                                   (SEQ ID NO: 22)
MEVPLYNIFGDNYIIQVATEAENSTIYNNKVEIDD

EELRNVLNLAYKIAKNNEDAAAERRGKAKKKKGEE

GETTTSNIILPLSGNDKNPWTETLKCYNFPTTVAL

SEVFKNFSQVKECEEVSAPSFVKPEFYEFGRSPGM

VERTRRVKLEVEPHYLIIAAAGWVLTRLGKAKVSE

GDYVGVNVFTPTRGILYSLIQNVNGIVPGIKPETA

FGLWIARKVVSSVTNPNVSVVRIYTISDAVGQNPT

TINGGFSIDLTKLLEKRYLLSERLEAIARNALSIS

SNMRERYIVLANYIYEYLTGSKRLEDLLYFANRDL

IMNLNSDDGKVRDLKLISAYVNGELIRGEG

>tr|FONH53|FONH53 SULIR CRISPR associated
protein, Casx OS = Sulfolobus islandicus
(strain REY15A) GN = SiRe_0771
PE = 4 SV = 1
                                   (SEQ ID NO: 23)
MEVPLYNIFGDNYIIQVATEAENSTIYNNKVEIDD

EELRNVLNLAYKIAKNNEDAAAERRGKAKKKKGEE

GETTTSNIILPLSGNDKNPWTETLKCYNFPTTVAL

SEVFKNFSQVKECEEVSAPSFVKPEFYKFGRSPGM

VERTRRVKLEVEPHYLIMAAAGWVLTRLGKAKVSE

GDYVGVNVFTPTRGILYSLIQNVNGIVPGIKPETA

FGLWIARKVVSSVTNPNVSVVSIYTISDAVGQNPT

TINGGFSIDLTKLLEKRDLLSERLEAIARNALSIS

SNMRERYIVLANYIYEYLTGSKRLEDLLYFANRDL

IMNLNSDDGKVRDLKLISAYVNGELIRGEG

CasY (ncbi.nlm.nih.gov/protein/
APG80656. 1)
>APG80656.1 CRISPR-associated
protein CasY [uncultured
Parcubacteria group
bacterium]
                                   (SEQ ID NO: 24)
MSKRHPRISGVKGYRLHAQRLEYTGKSGAMRTIKY

PLYSSPSGGRTVPREIVSAINDDYVGLYGLSNFDD

LYNAEKRNEEKVYSVLDFWYDCVQYGAVFSYTAPG

LLKNVAEVRGGSYELTKTLKGSHLYDELQIDKVIK

FLNKKEISRANGSLDKLKKDIIDCFKAEYRERHKD

QCNKLADDIKNAKKDAGASLGERQKKLFRDFFGIS

EQSENDKPSFTNPLNLTCCLLPFDTVNNNRNRGEV

LFNKLKEYAQKLDKNEGSLEMWEYIGIGNSGTAFS

NFLGEGFLGRLRENKITELKKAMMDITDAWRGQEQ

EEELEKRLRILAALTIKLREPKFDNHWGGYRSDIN

GKLSSWLQNYINQTVKIKEDLKGHKKDLKKAKEMI

NRFGESDTKEEAVVSSLLESIEKIVPDDSADDEKP

DIPAIAIYRRELSDGRLTLNREVQREDVQEALIKE

RLEAEKKKKPKKRKKKSDAEDEKETIDEKELEPHL

AKPLKLVPNEYGDSKRELYKKYKNAAIYTDALWKA

VEKIYKSAFSSSLKNSFEDTDFDKDFFIKRLQKIF

SVYRRENTDKWKPIVKNSFAPYCDIVSLAENEVLY
```

-continued

```
KPKQSRSRKSAAIDKNRVRLPSTENIAKAGIALAR

ELSVAGEDWKDLLKKEEHEEYIDLIELHKTALALL

LAVTETQLDISALDFVENGTVKDFMKTRDGNLVLE

GRFLEMESQSIVESELRGLAGLMSRKEFITRSAIQ

TMNGKQAELLYIPHEFQSAKITTPKEMSRAFLDLA

PAEFATSLEPESLSEKSLLKLKQMRYYPHYFGYEL

TRTGQGIDGGVAENALRLEKSPVKKREIKCKQYKT

LGRGQNKIVLYVRSSYYQTQFLEWELHRPKNVQTD

VAVSGSFLIDEKKVKTRWNYDALTVALEPVSGSER

VEVSQPFTIFPEKSAEEEGQRYLGIDIGEYGIAYT

ALEITGDSAKILDQNFISDPQLKTLREEVKGLKLD

QRRGTFAMPSTKIARIRESLVHSLRNRIHHLALKH

KAKIVYELEVSRFEEGKQKIKKVYATLKKADVYSE

IDADKNLQTTVWGKLAVASEISASYTSQFCGACKK

LWRAEMQVDETITTQELIGTVRVIKGGTLIDAIKD

FMRPPIFDENDTPFPKYRDFCDKHHISKKMRGNSC

LFICPFCRANADADIQASQTIALLRYVKEEKKVED

YFERFRKLKNIKVLGQMKKI
```

The term "CRISPR-Cas domain" or "CRISPR-Cas DNA binding domain" refers to an RNA-guided protein comprising a CRISPR associated (Cas) protein, or a fragment thereof (e.g., a protein comprising an active, inactive, or partially active DNA cleavage domain of a Cas protein, and/or the gRNA binding domain of Cas protein). CRISPR clusters are transcribed and processed into CRISPR RNA (crRNA). CRISPR clusters are transcribed and processed into CRISPR RNA (crRNA). In some CRISPR systems, correct processing of pre-crRNA requires a trans-encoded small RNA (tracrRNA), endogenous ribonuclease 3 (rnc) and a Cas protein. The tracrRNA serves as a guide for ribonuclease 3-aided processing of pre-crRNA. Subsequently, Cas9/crRNA and/or tracrRNA endonucleolytically cleaves linear or circular dsDNA target complementary to the spacer. In nature, DNA-binding and cleavage may require both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821 (2012), the entire contents of which is hereby incorporated by reference. Cas proteins recognize a short motif in the CRISPR repeat sequences (the PAM or protospacer adjacent motif) to help distinguish self versus non-self. CRISPR-Cas proteins include without limitation Cas9, CasX, CasY, Cpf1, C2cl, and C2c3 or active fragments thereof. Additional suitable CRISPR-Cas proteins and sequences will be apparent to those of skill in the art based on this disclosure.

A nuclease-inactivated CRISPR-Cas protein may interchangeably be referred to as a "dCas" protein (for nuclease-"dead" Cas) or catalytically inactive Cas. Methods for generating a Cas protein (or a fragment thereof) having an inactive DNA cleavage domain are known (See, e.g., Jinek et al., *Science*. 337:816-821 (2012); Qi et al., "Repurposing CRISPR as an RNA-Guided Platform for Sequence-Specific Control of Gene Expression" (2013) *Cell*. 28; 152 (5): 1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821 (2012); Qi et al., *Cell*. 28; 152 (5): 1173-83 (2013)). In some embodiments, a Cas nuclease has an inactive (e.g., an inactivated) DNA cleavage domain, that is, the Cas is a nickase, referred to as an "nCas" protein (for "nickase" Cas). A Cas variant shares homology to a CRISPR-Cas protein, or a fragment thereof. For example, a Cas variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to a wild type CRISPR-Cas protein. In some embodiments, the Cas variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to a wild type CRISPR-Cas protein. In some embodiments, the Cas variant comprises a fragment of a CRISPR-Cas protein (e.g., a gRNA programmable DNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of a wild type CRISPR-Cas protein. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type CRISPR-Cas protein. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

By "cytidine deaminase" is meant a polypeptide or fragment thereof capable of catalyzing a deamination reaction that converts an amino group to a carbonyl group. In one embodiment, the cytidine deaminase converts cytosine to uracil or 5-methylcytosine to thymine. PmCDA1, which is derived from *Petromyzon marinus* (*Petromyzon marinus* cytosine deaminase 1, "PmCDA1"), AID (Activation-induced cytidine deaminase; AICDA), which is derived from a mammal (e.g., human, swine, bovine, horse, monkey etc.), and APOBEC are exemplary cytidine deaminases.

The base sequence and amino acid sequence of PmCDA1 and the base sequence and amino acid sequence of CDS of human AID are shown herein below

```
>tr|A5H718|A5H718 PETMA Cytosine deaminase
OS = Petromyzon marinus OX = 7757
PE = 2 SV = 1
                                (SEQ ID NO: 25)
MTDAEYVRIHEKLDIYTEKKQFFNNKKSVSHRCYV

LFELKRRGERRACFWGYAVNKPQSGTERGIHAEIFS

IRKVEEYLRDNPGQFTINWYSSWSPCADCAEKILEW

YNQELRGNGHTLKIWACKLYYEKNARNQIGLWNLRD

NGVGLNVMVSEHYQCCRKIFIQSSHNQLNENRWLEK

TLKRAEKRRSELSIMIQVKILHTTKSPAV

>EF094822.1 Petromyzon marinus isolate
PmCDA.21 cytosine deaminase mRNA,
complete cds
                                (SEQ ID NO: 26)
TGACACGACACAGCCGTGTATATGAGGAAGGGTAG

CTGGATGGGGGGGGGGGAATACGTTCAGAGAGGA

CATTAGCGAGCGTCTTGTTGGTGGCCTTGAGTCTA

GACACCTGCAGACATGACCGACGCTGAGTACGTGA

GAATCCATGAGAAGTTGGACATCTACACGTTTAAG

AAACAGTTTTTCAACAACAAAAAATCCGTGTCGCA

TAGATGCTACGTTCTCTTTGAATTAAAACGACGGG

GTGAACGTAGAGCGTGTTTTTGGGGCTATGCTGTG

AATAAACCACAGAGCGGGACAGAACGTGGAATTCA

CGCCGAAATCTTTAGCATTAGAAAAGTCGAAGAAT

ACCTGCGCGACAACCCCGGACAATTCACGATAAAT

TGGTACTCATCCTGGAGTCCTTGTGCAGATTGCGC

TGAAAAGATCTTAGAATGGTATAACCAGGAGCTGC

GGGGGAACGGCCACACTTTGAAAATCTGGGCTTGC

AAACTCTATTACGAGAAAAATGCGAGGAATCAAAT

TGGGCTGTGGAACCTCAGAGATAACGGGGTTGGGT

TGAATGTAATGGTAAGTGAACACTACCAATGTTGC

AGGAAAATATTCATCCAATCGTCGCACAATCAATT

GAATGAGAATAGATGGCTTGAGAAGACTTTGAAGC

GAGCTGAAAAACGACGGAGCGAGTTGTCCATTATG

ATTCAGGTAAAAATACTCCACACCACTAAGAGTCC

TGCTGTTTAAGAGGCTATGCGGATGGTTTTC

>tr|Q6QJ80|Q6QJ80 HUMAN Activation-
induced cytidine deaminase
OS = Homo sapiens OX = 9606
GN = AICDA PE = 2 SV = 1
                                (SEQ ID NO: 27)
MDSLLMNRRKFLYQFKNVRWAKGRRETYLCYVVKR

RDSATSFSLDFGYLRNKNGCHVELLFLRYISDWDL

DPGRCYRVTWFTSWSPCYDCARHVADFLRGNPNLS

LRIFTARLYFCEDRKAEPEGLRRLHRAGVQIAIMT

FKAPV

>NG_011588.1:5001-15681 Homo sapiens
activation induced cytidine deaminase
(AICDA), RefSeqGene (LRG_17) on
chromosome 12
                                (SEQ ID NO: 28)
AGAGAACCATCATTAATTGAAGTGAGATTTTTCTG

GCCTGAGACTTGCAGGGAGGCAAGAAGACACTCTG

GACACCACTATGGACAGGTAAAGAGGCAGTCTTCT

CGTGGGTGATTGCACTGGCCTTCCTCTCAGAGCAA

ATCTGAGTAATGAGACTGGTAGCTATCCCTTTCTC

TCATGTAACTGTCTGACTGATAAGATCAGCTTGAT

CAATATGCATATATATTTTTTGATCTGTCTCCTTT

TCTTCTATTCAGATCTTATACGCTGTCAGCCCAAT

TCTTTCTGTTTCAGACTTCTCTTGATTTCCCTCTT

TTTCATGTGGCAAAAGAAGTAGTGCGTACAATGTA

CTGATTCGTCCTGAGATTTGTACCATGGTTGAAAC

TAATTTATGGTAATAATATTAACATAGCAAATCTT

TAGAGACTCAAATCATGAAAAGGTAATAGCAGTAC

TGTACTAAAAACGGTAGTGCTAATTTTCGTAATAA

TTTTGTAAATATTCAACAGTAAAACAACTTGAAGA

CACACTTTCCTAGGGAGGCGTTACTGAAATAATTT

AGCTATAGTAAGAAAATTTGTAATTTTAGAAATGC

CAAGCATTCTAAATTAATTGCTTGAAAGTCACTAT

GATTGTGTCCATTATAAGGAGACAAATTCATTCAA

GCAAGTTATTTAATGTTAAAGGCCCAATTGTTAGG

CAGTTAATGGCACTTTTACTATTAACTAATCTTTC

CATTTGTTCAGACGTAGCTTAACTTACCTCTTAGG

TGTGAATTTGGTTAAGGTCCTCATAATGTCTTTAT

GTGCAGTTTTTGATAGGTTATTGTCATAGAACTTA

TTCTATTCCTACATTTATGATTACTATGGATGTAT

GAGAATAACACCTAATCCTTATACTTTACCTCAAT

TTAACTCCTTTATAAAGAACTTACATTACAGAATA

AAGATTTTTAAAAATATATTTTTTGTAGAGACA

GGGTCTTAGCCCAGCCGAGGCTGGTCTCTAAGTCC

TGGCCCAAGCGATCCTCCTGCCTGGGCCTCCTAAA

GTGCTGGAATTATAGACATGAGCCATCACATCCAA

TATACAGAATAAAGATTTTTAATGGAGGATTTAAT

GTTCTTCAGAAAATTTTCTTGAGGTCAGACAATGT

CAAATGTCTCCTCAGTTTACACTGAGATTTTGAAA

ACAAGTCTGAGCTATAGGTCCTTGTGAAGGGTCCA
```

TTGGAAATACTTGTTCAAAGTAAAATGGAAAGCAA
AGGTAAAATCAGCAGTTGAAATTCAGAGAAAGACA
GAAAAGGAGAAAAGATGAAATTCAACAGGACAGAA
GGGAAATATATTATCATTAAGGAGGACAGTATCTG
TAGAGCTCATTAGTGATGGCAAAATGACTTGGTCA
GGATTATTTTTAACCCGCTTGTTTCTGGTTTGCAC
GGCTGGGGATGCAGCTAGGGTTCTGCCTCAGGGAG
CACAGCTGTCCAGAGCAGCTGTCAGCCTGCAAGCC
TGAAACACTCCCTCGGTAAAGTCCTTCCTACTCAG
GACAGAAATGACGAGAACAGGGAGCTGGAAACAGG
CCCCTAACCAGAGAAGGGAAGTAATGGATCAACAA
AGTTAACTAGCAGGTCAGGATCACGCAATTCATTT
CACTCTGACTGGTAACATGTGACAGAAACAGTGTA
GGCTTATTGTATTTTCATGTAGAGTAGGACCCAAA
AATCCACCCAAAGTCCTTTATCTATGCCACATCCT
TCTTATCTATACTTCCAGGACACTTTTTCTTCCTT
ATGATAAGGCTCTCTCTCTCTCCACACACACACAC
ACACACACACACACACACACACACACACACAAA
CACACACCCCGCCAACCAAGGTGCATGTAAAAGA
TGTAGATTCCTCTGCCTTTCTCATCTACACAGCCC
AGGAGGGTAAGTTAATATAAGAGGGATTTATTGGT
AAGAGATGATGCTTAATCTGTTTAACACTGGGCCT
CAAAGAGAGAATTTCTTTTCTTCTGTACTTATTAA
GCACCTATTATGTGTTGAGCTTATATATACAAAGG
GTTATTATATGCTAATATAGTAATAGTAATGGTGG
TTGGTACTATGGTAATTACCATAAAAATTATTATC
CTTTTAAAATAAAGCTAATTATTATTGGATCTTTT
TTAGTATTCATTTTATGTTTTTTATGTTTTTGATT
TTTTAAAAGACAATCTCACCCTGTTACCCAGGCTG
GAGTGCAGTGGTGCAATCATAGCTTTCTGCAGTCT
TGAACTCCTGGGCTCAAGCAATCCTCCTGCCTTGG
CCTCCCAAAGTGTTGGGATACAGTCATGAGCCACT
GCATCTGGCCTAGGATCCATTTAGATTAAAATATG
CATTTTAAATTTTAAAATAATATGGCTAATTTTTA
CCTTATGTAATGTGTATACTGGCAATAAATCTAGT
TTGCTGCCTAAAGTTTAAAGTGCTTTCCAGTAAGC
TTCATGTACGTGAGGGGAGACATTTAAAGTGAAAC
AGACAGCCAGGTGTGGTGGCTCACGCCTGTAATCC
CAGCACTCTGGGAGGCTGAGGTGGGTGGATCGCTT
GAGCCCTGGAGTTCAAGACCAGCCTGAGCAACATG
GCAAAACGCTGTTTCTATAACAAAAATTAGCCGGG
CATGGTGGCATGTGCCTGTGGTCCCAGCTACTAGG
GGGCTGAGGCAGGAGAATCGTTGGAGCCCAGGAGG
TCAAGGCTGCACTGAGCAGTGCTTGCGCCACTGCA
CTCCAGCCTGGGTGACAGGACCAGACCTTGCCTCA
AAAAAATAAGAAGAAAAATTAAAAATAAATGGAAA
CAACTACAAAGAGCTGTTGTCCTAGATGAGCTACT
TAGTTAGGCTGATATTTTGGTATTTAACTTTTAAA
GTCAGGGTCTGTCACCTGCACTACATTATTAAAAT
ATCAATTCTCAATGTATATCCACACAAAGACTGGT
ACGTGAATGTTCATAGTACCTTTATTCACAAAACC
CCAAAGTAGAGACTATCCAAATATCCATCAACAAG
TGAACAAATAAACAAAATGTGCTATATCCATGCAA
TGGAATACCACCCTGCAGTACAAAGAAGCTACTTG
GGGATGAATCCCAAAGTCATGACGCTAAATGAAAG
AGTCAGACATGAAGGAGGAGATAATGTATGCCATA
CGAAATTCTAGAAAATGAAAGTAACTTATAGTTAC
AGAAAGCAAATCAGGGCAGGCATAGAGGCTCACAC
CTGTAATCCCAGCACTTTGAGAGGCCACGTGGGAA
GATTGCTAGAACTCAGGAGTTCAAGACCAGCCTGG
GCAACACAGTGAAACTCCATTCTCCACAAAAATGG
GAAAAAAGAAAGCAAATCAGTGGTTGTCCTGTGG
GGAGGGGAAGGACTGCAAAGAGGGAAGAAGCTCTG
GTGGGGTGAGGGTGGTGATTCAGGTTCTGTATCCT
GACTGTGGTAGCAGTTTGGGGTGTTTACATCCAAA
AATATTCGTAGAATTATGCATCTTAAATGGGTGGA
GTTTACTGTATGTAAATTATACCTCAATGTAAGAA
AAAATAATGTGTAAGAAAACTTTCAATTCTCTTGC
CAGCAAACGTTATTCAAATTCCTGAGCCCTTTACT
TCGCAAATTCTCTGCACTTCTGCCCCGTACCATTA
GGTGACAGCACTAGCTCCACAAATTGGATAAATGC
ATTTCTGGAAAAGACTAGGGACAAAATCCAGGCAT
CACTTGTGCTTTCATATCAACCATGCTGTACAGCT
TGTGTTGCTGTCTGCAGCTGCAATGGGGACTCTTG
ATTTCTTTAAGGAAACTTGGGTTACCAGAGTATTT
CCACAAATGCTATTCAAATTAGTGCTTATGATATG
CAAGACACTGTGCTAGGAGCCAGAAAACAAAGAGG
AGGAGAAATCAGTCATTATGTGGGAACAACATAGC
AAGATATTTAGATCATTTTGACTAGTTAAAAAAGC
AGCAGAGTACAAAATCACACATGCAATCAGTATAA
TCCAAATCATGTAAATATGTGCCTGTAGAAAGACT

-continued

AGAGGAATAAACACAAGAATCTTAACAGTCATTGT
CATTAGACACTAAGTCTAATTATTATTATTAGACA
CTATGATATTTGAGATTTAAAAAATCTTTAATATT
TTAAAATTTAGAGCTCTTCTATTTTTCCATAGTAT
TCAAGTTTGACAATGATCAAGTATTACTCTTTCTT
TTTTTTTTTTTTTTTTTTTTTGAGATGGAGTTT
TGGTCTTGTTGCCCATGCTGGAGTGGAATGGCATG
ACCATAGCTCACTGCAACCTCCACCTCCTGGGTTC
AAGCAAAGCTGTCGCCTCAGCCTCCCGGGTAGATG
GGATTACAGGCGCCCACCACCACACTCGGCTAATG
TTTGTATTTTTAGTAGAGATGGGGTTTCACCATGT
TGGCCAGGCTGGTCTCAAACTCCTGACCTCAGAGG
ATCCACCTGCCTCAGCCTCCCAAAGTGCTGGGATT
ACAGATGTAGGCCACTGCGCCCGGCCAAGTATTGC
TCTTATACATTAAAAAACAGGTGTGAGCCACTGCG
CCCAGCCAGGTATTGCTCTTATACATTAAAAAATA
GGCCGGTGCAGTGGCTCACGCCTGTAATCCCAGCA
CTTTGGGAAGCCAAGGCGGGCAGAACACCCGAGGT
CAGGAGTCCAAGGCCAGCCTGGCCAAGATGGTGAA
ACCCCGTCTCTATTAAAAATACAAACATTACCTGG
GCATGATGGTGGGCGCCTGTAATCCCAGCTACTCA
GGAGGCTGAGGCAGGAGGATCCGCGGAGCCTGGCA
GATCTGCCTGAGCCTGGGAGGTTGAGGCTACAGTA
AGCCAAGATCATGCCAGTATACTTCAGCCTGGGCG
ACAAAGTGAGACCGTAACAAAAAAAAAAAAATTTA
AAAAAAGAAATTTAGATCAAGATCCAACTGTAAAA
AGTGGCCTAAACACCACATTAAAGAGTTTGGAGTT
TATTCTGCAGGCAGAAGAGAACCATCAGGGGGTCT
TCAGCATGGGAATGGCATGGTGCACCTGGTTTTTG
TGAGATCATGGTGGTGACAGTGTGGGAATGTTAT
TTTGGAGGGACTGGAGGCAGACAGACCGGTTAAAA
GGCCAGCACAACAGATAAGGAGGAAGAAGATGAGG
GCTTGGACCGAAGCAGAGAAGAGCAAACAGGGAAG
GTACAAATTCAAGAAATATTGGGGGGTTTGAATCA
ACACATTTAGATGATTAATTAAATATGAGGACTGA
GGAATAAGAAATGAGTCAAGGATGGTTCCAGGCTG
CTAGGCTGCTTACCTGAGGTGGCAAAGTCGGGAGG
AGTGGCAGTTTAGGACAGGGGGCAGTTGAGGAATA
TTGTTTTGATCATTTTGAGTTTGAGGTACAAGTTG
GACACTTAGGTAAAGACTGGAGGGGAAATCTGAAT

-continued

ATACAATTATGGGACTGAGGAACAAGTTTATTTTA
TTTTTTGTTTCGTTTTCTTGTTGAAGAACAAATTT
AATTGTAATCCCAAGTCATCAGCATCTAGAAGACA
GTGGCAGGAGGTGACTGTCTTGTGGGTAAGGGTTT
GGGGTCCTTGATGAGTATCTCTCAATTGGCCTTAA
ATATAAGCAGGAAAAGGAGTTTATGATGGATTCCA
GGCTCAGCAGGGCTCAGGAGGGCTCAGGCAGCCAG
CAGAGGAAGTCAGAGCATCTTCTTTGGTTTAGCCC
AAGTAATGACTTCCTTAAAAAGCTGAAGGAAAATC
CAGAGTGACCAGATTATAAACTGTACTCTTGCATT
TTCTCTCCCTCCTCTCACCCACAGCCTCTTGATGA
ACCGGAGGAAGTTTCTTTACCAATTCAAAAATGTC
CGCTGGGCTAAGGGTCGGCGTGAGACCTACCTGTG
CTACGTAGTGAAGAGGCGTGACAGTGCTACATCCT
TTTCACTGGACTTTGGTTATCTTCGCAATAAGGTA
TCAATTAAAGTCGGCTTTGCAAGCAGTTTAATGGT
CAACTGTGAGTGCTTTTAGAGCCACCTGCTGATGG
TATTACTTCCATCCTTTTTTGGCATTTGTGTCTCT
ATCACATTCCTCAAATCCTTTTTTTTATTTCTTTT
TCCATGTCCATGCACCCATATTAGACATGGCCCAA
AATATGTGATTTAATTCCTCCCCAGTAATGCTGGG
CACCCTAATACCACTCCTTCCTTCAGTGCCAAGAA
CAACTGCTCCCAAACTGTTTACCAGCTTTCCTCAG
CATCTGAATTGCCTTTGAGATTAATTAAGCTAAAA
GCATTTTTATATGGGAGAATATTATCAGCTTGTCC
AAGCAAAAATTTTAAATGTGAAAAACAAATTGTGT
CTTAAGCATTTTTGAAAATTAAGGAAGAAGAATTT
GGGAAAAAATTAACGGTGGCTCAATTCTGTCTTCC
AAATGATTTCTTTTCCCTCCTACTCACATGGGTCG
TAGGCCAGTGAATACATTCAACATGGTGATCCCCA
GAAAACTCAGAGAAGCCTCGGCTGATGATTAATTA
AATTGATCTTTCGGCTACCCGAGAGAATTACATTT
CCAAGAGACTTCTTCACCAAAATCCAGATGGGTTT
ACATAAACTTCTGCCCACGGGTATCTCCTCTCTCC
TAACACGCTGTGACGTCTGGGCTTGGTGGAATCTC
AGGGAAGCATCCGTGGGGTGGAAGGTCATCGTCTG
GCTCGTTGTTTGATGGTTATATTACCATGCAATTT
TCTTTGCCTACATTTGTATTGAATACATCCCAATC
TCCTTCCTATTCGGTGACATGACACATTCTATTTC
AGAAGGCTTTGATTTTATCAAGCACTTTCATTTAC
TTCTCATGGCAGTGCCTATTACTTCTCTTACAATA

-continued

CCCATCTGTCTGCTTTACCAAAATCTATTTCCCCT
TTTCAGATCCTCCCAAATGGTCCTCATAAACTGTC
CTGCCTCCACCTAGTGGTCCAGGTATATTTCCACA
ATGTTACATCAACAGGCACTTCTAGCCATTTTCCT
TCTCAAAAGGTGCAAAAAGCAACTTCATAAACACA
AATTAAATCTTCGGTGAGGTAGTGTGATGCTGCTT
CCTCCCAACTCAGCGCACTTCGTCTTCCTCATTCC
ACAAAAACCCATAGCCTTCCTTCACTCTGCAGGAC
TAGTGCTGCCAAGGGTTCAGCTCTACCTACTGGTG
TGCTCTTTTGAGCAAGTTGCTTAGCCTCTCTGTAA
CACAAGGACAATAGCTGCAAGCATCCCCAAAGATC
ATTGCAGGAGACAATGACTAAGGCTACCAGAGCCG
CAATAAAGTCAGTGAATTTTAGCGTGGTCCTCTC
TGTCTCTCCAGAACGGCTGCCACGTGGAATTGCTC
TTCCTCCGCTACATCTCGGACTGGGACCTAGACCC
TGGCCGCTGCTACCGCGTCACCTGGTTCACCTCCT
GGAGCCCCTGCTACGACTGTGCCCGACATGTGGCC
GACTTTCTGCGAGGGAACCCCAACCTCAGTCTGAG
GATCTTCACCGCGCGCCTCTACTTCTGTGAGGACC
GCAAGGCTGAGCCCGAGGGGCTGCGGCGGCTGCAC
CGCGCCGGGGTGCAAATAGCCATCATGACCTTCAA
AGGTGCGAAAGGGCCTTCCGCGCAGGCGCAGTGCA
GCAGCCCGCATTCGGGATTGCGATGCGGAATGAAT
GAGTTAGTGGGGAAGCTCGAGGGGAAGAAGTGGGC
GGGGATTCTGGTTCACCTCTGGAGCCGAAATTAAA
GATTAGAAGCAGAGAAAAGAGTGAATGGCTCAGAG
ACAAGGCCCCGAGGAAATGAGAAAATGGGGCCAGG
GTTGCTTCTTTCCCCTCGATTTGGAACCTGAACTG
TCTTCTACCCCCATATCCCCGCCTTTTTTTCCTTT
TTTTTTTTTTGAAGATTATTTTACTGCTGGAATA
CTTTTGTAGAAAACCACGAAAGAACTTTCAAAGCC
TGGGAAGGGCTGCATGAAAATTCAGTTCGTCTCTC
CAGACAGCTTCGGCGCATCCTTTTGGTAAGGGGCT
TCCTCGCTTTTTAAATTTTCTTTCTTTCTCTACAG
TCTTTTTTGGAGTTTCGTATATTTCTTATATTTTC
TTATTGTTCAATCACTCTCAGTTTTCATCTGATGA
AAACTTTATTTCTCCTCCACATCAGCTTTTTCTTC
TGCTGTTTCACCATTCAGAGCCCTCTGCTAAGGTT
CCTTTTCCCTCCCTTTTCTTTCTTTTGTTGTTTCA
CATCTTTAAATTTCTGTCTCTCCCCAGGGTTGCGT

-continued

TTCCTTCCTGGTCAGAATTCTTTTCTCCTTTTTTT
TTTTTTTTTTTTTTTTTTTAAACAAACAAACAAA
AAACCCAAAAAAACTCTTTCCCAATTTACTTTCTT
CCAACATGTTACAAAGCCATCCACTCAGTTTAGAA
GACTCTCCGGCCCCACCGACCCCCAACCTCGTTTT
GAAGCCATTCACTCAATTTGCTTCTCTCTTTCTCT
ACAGCCCTGTATGAGGTTGATGACTTACGAGACG
CATTTCGTACTTTGGGACTTTGATAGCAACTTCCA
GGAATGTCACACACGATGAAATATCTCTGCTGAAG
ACAGTGGATAAAAAACAGTCCTTCAAGTCTTCTCT
GTTTTTATTCTTCAACTCTCACTTTCTTAGAGTTT
ACAGAAAAAATATTTATATACGACTCTTTAAAAAG
ATCTATGTCTTGAAAATAGAGAAGGAACACAGGTC
TGGCCAGGGACGTGCTGCAATTGGTGCAGTTTTGA
ATGCAACATTGTCCCCTACTGGGAATAACAGAACT
GCAGGACCTGGGAGCATCCTAAAGTGTCAACGTTT
TTCTATGACTTTTAGGTAGGATGAGAGCAGAAGGT
AGATCCTAAAAAGCATGGTGAGAGGATCAAATGTT
TTTATATCAACATCCTTTATTATTTGATTCATTTG
AGTTAACAGTGGTGTTAGTGATAGATTTTTCTATT
CTTTTCCCTTGACGTTTACTTTCAAGTAACACAAA
CTCTTCCATCAGGCCATGATCTATAGGACCTCCTA
ATGAGAGTATCTGGGTGATTGTGACCCCAAACCAT
CTCTCCAAAGCATTAATATCCAATCATGCGCTGTA
TGTTTTAATCAGCAGAAGCATGTTTTTATGTTTGT
ACAAAAGAAGATTGTTATGGGTGGGGATGGAGGTA
TAGACCATGCATGGTCACCTTCAAGCTACTTTAAT
AAAGGATCTTAAAATGGGCAGGAGGACTGTGAACA
AGACACCCTAATAATGGGTTGATGTCTGAAGTAGC
AAATCTTCTGGAAACGCAAACTCTTTTAAGGAAGT
CCCTAATTTAGAAACACCCACAAACTTCACATATC
ATAATTAGCAAACAATTGGAAGGAAGTTGCTTGAA
TGTTGGGGAGAGGAAAATCTATTGGCTCTCGTGGG
TCTCTTCATCTCAGAAATGCCAATCAGGTCAAGGT
TTGCTACATTTGTATGTGTGTGATGCTTCTCCCA
AAGGTATATTAACTATATAAGAGAGTTGTGACAAA
ACAGAATGATAAAGCTGCGAACCGTGGCACACGCT
CATAGTTCTAGCTGCTTGGGAGGTTGAGGAGGGAG
GATGGCTTGAACACAGGTGTTCAAGGCCAGCCTGG
GCAACATAACAAGATCCTGTCTCTCAAAAAAAAAA
AAAAAAAAAGAAAGAGAGAGGGCCGGGCGTGGTG

```
GCTCACGCCTGTAATCCCAGCACTTTGGGAGGCCG

AGCCGGGCGGATCACCTGTGGTCAGGAGTTTGAGA

CCAGCCTGGCCAACATGGCAAAACCCCGTCTGTAC

TCAAAATGCAAAAATTAGCCAGGCGTGGTAGCAGG

CACCTGTAATCCCAGCTACTTGGGAGGCTGAGGCA

GGAGAATCGCTTGAACCCAGGAGGTGGAGGTTGCA

GTAAGCTGAGATCGTGCCGTTGCACTCCAGCCTGG

GCGACAAGAGCAAGACTCTGTCTCAGAAAAAAAAA

AAAAAAAGAGAGAGAGAGAGAAAGAGAACAATATT

TGGGAGAGAAGGATGGGGAAGCATTGCAAGGAAAT

TGTGCTTTATCCAACAAAATGTAAGGAGCCAATAA

GGGATCCCTATTTGTCTCTTTTGGTGTCTATTTGT

CCCTAACAACTGTCTTTGACAGTGAGAAAAATATT

CAGAATAACCATATCCCTGTGCCGTTATTACCTAG

CAACCCTTGCAATGAAGATGAGCAGATCCACAGGA

AAACTTGAATGCACAACTGTCTTATTTTAATCTTA

TTGTACATAAGTTTGTAAAAGAGTTAAAAATTGTT

ACTTCATGTATTCATTTATATTTTATATTATTTTG

CGTCTAATGATTTTTATTAACATGATTTCCTTTT

CTGATATATTGAAATGGAGTCTCAAAGCTTCATAA

ATTTATAACTTTAGAAATGATTCTAATAACAACGT

ATGTAATTGTAACATTGCAGTAATGGTGCTACGAA
```

```
GCCATTTCTCTTGATTTTTAGTAAACTTTTATGAC

AGCAAATTTGCTTCTGGCTCACTTTCAATCAGTTA

AATAAATGATAAATAATTTTGGAAGCTGTGAAGAT

AAAATACCAAATAAAATAATATAAAAGTGATTTAT

ATGAAGTTAAAATAAAAAATCAGTATGATGGAATA

AACTTG
```

Apolipoprotein B mRNA editing enzyme, catalytic polypeptide-like (APOBEC) is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. A number of modified cytidine deaminases are commercially available, including but not limited to SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177).

Other exemplary deaminases that can be fused to Cas9 according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

```
Human AID:
                                                         (SEQ ID NO: 29)
MDSLLMNRRKFLYQFKNVRWAKGRRETYLCYVVKRRDSATSFSLDFGYLRNKNGCHVELLFLRYISDWDLDPGRCYRVT

WFTSWSPCYDCARHVADFLRGNPNLSLRIFTARLYFCEDRKAEPEGLRRLHRAGVQIAIMTFKDYFYCWNTFVENHERT

FKAWEGLHENSVRLSRQLRRILLPLYEVDDLRDAFRTLGL (underline: nuclear localization sequence; double underline: nuclear export signal)

Mouse AID:
                                                         (SEQ ID NO: 30)
MDSLLMKQKKFLYHFKNVRWAKGRHETYLCYVVKRRDSATSCSLDFGHLRNKSGCHVELLFLRYISDWDLDPGRCYRVT

WFTSWSPCYDCARHVAEFLRWNPNLSLRIFTARLYFCEDRKAEPEGLRRLHRAGVQIGIMTFKDYFYCWNTFVENRERT

FKAWEGLHENSVRLTRQLRRILLPLYEVDDLRDAFRMLGF (underline: nuclear localization sequence; double underline: nuclear export signal)

Canine AID:
                                                         (SEQ ID NO: 31)
MDSLLMKQRKFLYHFKNVRWAKGRHETYLCYVVKRRDSATSFSLDFGHLRNKSGCHVELLFLRYISDWDLDPGRCYRVT

WFTSWSPCYDCARHVADFLRGYPNLSLRIFAARLYFCEDRKAEPEGLRRLHRAGVQIAIMTFKDYFYCWNTFVENREKT

FKAWEGLHENSVRLSRQLRRILLPLYEVDDLRDAFRTLGL (underline: nuclear localization sequence; double underline: nuclear export signal)
```

-continued

Bovine AID:
(SEQ ID NO: 32)
<u>MDSLLKKQRQFLYQFKNVRWAKGRHETYLCYVVKRRDSPTSFSLDFGHLRNKAGCHVELLFLRYISDWDLDPGRCYRVT</u>WFTSWSPCYDCARHVADFLRGYPNLSLRIFTARLYFCDKERKAEPEGLRRLHRAGVQIAIMTFKDYFYCWNTFVENHER TFKAWEGLHENSVRLSRQLRRILL<u>PLYEVDDLRDAFRTLGL</u> (underline: nuclear localization sequence; double underline: nuclear export signal)

Rat AID
(SEQ ID NO: 33)
<u>MAVGSKPKAALVGPHWERERIWCFLC</u>STGLGTQQTGQTSRWLRPAATQDPVSPPRSLLMKQRKFLYHFKNVRWAKGRHE TYLCYVVKRRDSATSFSLDFGYLRNKSGCHVELLFLRYISDWDLDPGRCYRVTWFTSWSPCYDCARHVADFLRGNPNLS LRIFTARLTGWGALPAGLMSPARPSDYFYCWNTFV<u>ENHERTFKAWEGLHENSVRLSRRLRRILLPLYEVDDLRDAFRTL GL</u> (underline: nuclear localization sequence; double underline: nuclear export signal)

Mouse APOBEC-3
(SEQ ID NO: 34)
MGPFCLGCSHRKCYSPIRNLISQETFKFHFKNLGYAKGRKDTFLCYEVTRKDCDSPVSLHHGVFKNKDNI*HAEICFLYW FHDKVLKVLSPREEFKITWYMSWSPCFEC*AEQIVRFLATHHNLSLDIFSSRLYNVQDPETQQNLCRLVQEGAQVAAMDL YEFKKCWKKFVDNGGRRFRPWKRLLTNFRYQDSKLQEILRPCYIPVPSSSSSTLSNICLTKGLPETRFCVEGRRMDPLS EEEFYSQFYNQRVKHLCYYHRMKPYLCYQLEQFNGQAPLKGCLLSEKGKQ*HAEILFLDKIRSMELSQVTITCYLTWSPC PNC*AWQLAAFKRDRPDLILHIYTSRLYFHWKRPFQKGLCSLWQSGILVDVMDLPQFTDCWTNFVNPKRPFWPWKGLEII SRRTQRRLRRIKESWGLQDLVNDFGNLQLGPPMS (italic: nucleic acid editing domain)

Rat APOBEC-3:
(SEQ ID NO: 35)
MGPFCLGCSHRKCYSPIRNLISQETFKFHFKNRLRYAIDRKDTFLCYEVTRKDCDSPVSLHHGVFKNKDNI*HAEICFLY WFHDKVLKVLSPREEFKITWYMSWSPCFEC*AEQVLRFLATHHNLSLDIFSSRLYNIRDPENQQNLCRLVQEGAQVAAMD LYEFKKCWKKFVDNGGRRFRPWKKLLTNFRYQDSKLQEILRPCYIPVPSSSSSTLSNICLTKGLPETRFCVERRRVHLL SEEEFYSQFYNQRVKHLCYYHGVKPYLCYQLEQFNGQAPLKGCLLSEKGKQ*HAEILFLDKIRSMELSQVIITCYLTWSP CPNC*AWQLAAFKRDRPDLILHIYTSRLYFHWKRPFQKGLCSLWQSGILVDVMDLPQFTDCWINFVNPKRPFWPWKGLEI ISRRTQRRLRHIKESWGLQDLVNDFGNLQLGPPMS (italic: nucleic acid editing domain)

*Rhesus macaque* APOBEC-3G:
(SEQ ID NO: 36)
<u>MVEPMDPRTFVSNFNNRPILSGLNTVWLCCEVKTKDPSGPPLDAKIFQGKVYSKAKYHPEMRFLRWFHKWRQLHHDQEY</u> KVTWYVSWSPCTRCANSVATFLAKDPKVTLTIFVARLYYFWKPDYQQALRILCQKRGGPHATMKIMNYNEFQDCWNKFV DGRGKPFKPRNNLPKHYTLLQATLGELLRHLMDPGTFTSNFNNKPWVSGQHETYLCYKVERLHNDTWVPLNQHRGFLRN QAPNIHGFPKGRHAELCFLDLIPFWKLDGQQYRVTCFTSWSPCFSCAQEMAKFISNNEHVSLCIFAARIYDDQGRYQEG LRALHRDGAKIAMMNYSEFEYCWDTFVDRQGRPFQPWDGLDEHSQALSGRLRAI (italic: nucleic acid editing domain; underline: cytoplasmic localization signal)

Chimpanzee APOBEC-3G:
(SEQ ID NO: 37)
<u>MKPHFRNPVERMYQDTFSDNFYNRPILSHRNTVWLCYEVKTKGPSRPPLDAKIFRGQVYSKLKY</u>*HPEMRFFHWFSKWRK LHRDQEYEVTWYISWSPCTKC*TRDVATFLAEDPKVTLTIFVARLYYFWDPDYQEALRSLCQKRDGPRATMKIMNYDEFQ HCWSKFVYSQRELFEPWNNLPKYYILLHIMLGEILRHSMDPPTFTSNFNNELWVRGRHETYLCYEVERLHNDTWVLLNQ RRGFLCNQAPHKHGFLEGR*HAELCFLDVIPFWKLDLHQDYRVTCFTSWSPCFSC*AQEMAKFISNNKHVSLCIFAARIYD DQGRCQEGLRTLAKAGAKISIMTYSEFKHCWDTFVDHQGCPFQPWDGLEEHSQALSGRLRAILQNQGN (italic: nucleic acid editing domain; underline: cytoplasmic localization signal)

Green monkey APOBEC-3G:

(SEQ ID NO: 38)

MNPQIRNMVEQMEPDIFVYYFNNRPILSGRNTVWLCYEVKTKDPSGPPLDANIFQGKLYPEAKD*HPEMKFLHWFRKWRQ*

*LHRDQEYEVTWYVSWSPCTRC*ANSVATFLAEDPKVTLTIFVARLYYFWKPDYQQALRILCQERGGPHATMKIMNYNEFQ

HCWNEFVDGQGKPFKPRKNLPKHYTLLHATLGELLRHVMDPGTFTSNFNNKPWVSGQRETYLCYKVERSHNDTWVLLNQ

HRGFLRNQAPDRHGFPKGR*HAELCFLDLIPFWKLDDQQYRVTCFTSWSPCFSC*AQKNIAKFISNNKHVSLCIFAARIYD

DQGRCQEGLRTLHRDGAKIAVMNYSEFEYCWDTFVDRQGRPFQPWDGLDEHSQALSGRLRAI (italic:

nucleic acid editing domain; underline: cytoplasmiclocalizationsignal)

Human APOBEC-3G:

(SEQ ID NO: 39)

MKPHFRNTVERMYRDTFSYNFYNRPILSRRNTVWLCYEVKTKGPSRPPLDAKIFRGQVYSELKY*HPEMRFFHWFSKWRK*

*LHRDQEYEVTWYISWSPCTKC*TRDMATFLAEDPKVTLTIFVARLYYFWDPDYQEALRSLCQKRDGPRATMKIMNYDEFQ

HCWSKFVYSQRELFEPWNNLPKYYILLHIMLGEILRHSMDPPTFTFNFNNEPWVRGRHETYLCYEVERMHNDTWVLLNQ

RRGFLCNQAPHKHGFLEGR*HAELCFLDVIPFWKLDLDQDYRVTCFTSWSPCFSC*AQEMAKFISKNKHVSLCIFTARIYD

DQGRCQEGLRTLAEAGAKISIMTYSEFKHCWDTFVDHQGCPFQPWDGLDEHSQDLSGRLRAILQNQEN (italic:

nucleic acid editing domain; underline: cytoplasmic localization signal)

Human APOBEC-3F:

(SEQ ID NO: 40)

MKPHFRNTVERMYRDTFSYNFYNRPILSRRNTVWLCYEVKTKGPSRPRLDAKIFRGQVYSQPEH*HAEMCFLLWFCGNQL*

*PAYKCFQITWFVSWTPCPDC*VAKLAEFLAEHPNVTLTISAARLYYWERDYRRALCRLSQAGARVKIMDDEEFAYCWEN

FVYSEGQPFMPWYKFDDNYAFLHRTLKEILRNPMEAMYPHIFYFHFKNLRKAYGRNESWLCFTMEVVKHHSPVSWKRGV

FRNQVDPETH*CHAERCFLSWFCDDILSPNTNYEVTWYTSWSPCPEC*AGEVAEFLARHSNVNLTIFTARLYYFWDTDYQE

GLRSLSQEGASVEIMGYKDFKYCWENFVYNDDEPFKPWKGLKYNFLFLDSKLQEILE (italic: nucleic acid editing domain)

Human APOBEC-3B:

(SEQ ID NO: 41)

MNPQIRNPMERMYRDTFYDNFENEPILYGRSYTWLCYEVKIKRGRSNLLWDTGVFRGQVYFKPQY*HAEMCFLSWFCGNQ*

*LPAYKCFQITWFVSWTPCPDC*VAKLAEFLSEHPNVTLTISAARLYYWERDYRRALCRLSQAGARVTIMDYEEFAYCWE

NFVYNEGQQFMPWYKFDENYAFLHRTLKEILRYLMDPDTFTFNFNNDPLVLRRRQTYLCYEVERLDNGTWVLMDQHMGF

LCNEAKNLLCGFY*GRHAELRFLDLVPSLQLDPAQIYRVTWFISWSPCFSWGC*AGEVRAFLQENTHVRLRIFAARIYDYD

PLYKEALQMLRDAGAQVSIMTYDEFEYCWDTFVYRQGCPFQPWDGLEEHSQALSGRLRAILQNQGN (italic:

nucleic acid editing domain)

Rat APOBEC-3B:

(SEQ ID NO: 42)

MQPQGLGPNAGMGPVCLGCSHRRPYSPRINPLKKLYQQTFYFHFKNVRYAWGRKNNFLCYEVNGMDCALPVPLRQGVFR

KQGHIHAELCFIYQFHDKVLRVLSPMEEFKVTWYMSWSPCSKCAEQVARFLAAHRNLSLAIFSSRLYYYLRNPNYQQKL

CRLIQEGVHVAAMDLPEFKKCWNKFVDNDGQPFRPWMRLRINFSFYDCKLQEIFSRMNLLREDVFYLQFNNSHRVKPVQ

NRYYRRKSYLCYQLERANGQEPLKGYLLYKKGEQHVEILFLEKMRSMELSQVRITCYLTWSPCPNCARQLAAFKKDHPD

LILRIYTSRLYFWRKKFQKGLCTLWRSGIHVDVMDLPQFADCWTNFVNPQRPFRPWNELEKNSWRIQRRLRRIKESWGL

Bovine APOBEC-3B:

(SEQ ID NO: 43)

DGWEVAFRSGTVLKAGVLGVSMTEGWAGSGHPGQGACVWTPGTRNTMNLLREVLFKQQFGNQPRVPAPYYRRKTYLCYQ

LKQRNDLTLDRGCFRNKKQRHAERFIDKINSLDLNPSQSYKIICYITWSPCPNCANELVNFITRNNHLKLEIFASRLYF

HWIKSFKMGLQDLQNAGISVAVMTHTEFEDCWEQFVDNQSRPFQPWDKLEQYSASIRRRLQRILTAPI

Chimpanzee APOBEC-3B:
(SEQ ID NO: 44)
MNPQIRNPMEWMYQRTFYYNFENEPILYGRSYTWLCYEVKIRRGHSNLLWDTGVFRGQMYSQPEHHAEMCFLSWFCGNQ

LSAYKCFQITWFVSWTPCPDCVAKLAKFLAEHPNVTLTISAARLYYYWERDYRRALCRLSQAGARVKIMDDEEFAYCWE

NFVYNEGQPFMPWYKFDDNYAFLHRTLKEIIRHLMDPDTFTFNFNNDPLVLRRHQTYLCYEVERLDNGTWVLMDQHMGF

LCNEAKNLLCGFYGRHAELRFLDLVPSLQLDPAQIYRVTWFISWSPCFSWGCAGQVRAFLQENTHVRLRIFAARIYDYD

PLYKEALQMLRDAGAQVSIMTYDEFEYCWDTFVYRQGCPFQPWDGLEEHSQALSGRLRAILQVRASSLCMVPHRPPPPP

QSPGPCLPLCSEPPLGSLLPTGRPAPSLPFLLTASFSFPPPASLPPLPSLSLSPGHLPVPSFHSLTSCSIQPPCSSRIR

ETEGWASVSKEGRDLG

Human APOBEC-3C:
(SEQ ID NO: 45)
MNPQIRNPMKAMYPGTFYFQFKNLWEANDRNETWLCFTVEGIKRRSVVSWKTGVFRNQVDSETHCHAERCFLSWFCDDI

LSPNTKYQVTWYTSWSPCPDCAGEVAEFLARHSNVNLTIFTARLYYFQYPCYQEGLRSLSQEGVAVEIMDYEDFKYCWE

NFVYNDNEPFKPWKGLKTNFRLLKRRLRESLQ (italic: nucleic acid editing domain)

Gorilla APOBEC3C
(SEQ ID NO: 46)
MNPQIRNPMKAMYPGTFYFQFKNLWEANDRNETWLCFTVEGIKRRSVVSWKTGVFRNQVDSETHCHAERCFLSWECDDI

LSPNTNYQVTWYTSWSPCPECAGEVAEFLARHSNVNLTIFTARLYYFQDTDYQEGLRSLSQEGVAVKIMDYKDFKYCWE

NFVYNDDEPFKPWKGLKYNFRFLKRRLQEILE (italic: nucleic acid editing domain)

Human APOBEC-3A:
(SEQ ID NO: 47)
MEASPASGPRHLMDPHIFTSNFNNGIGRHKTYLCYEVERLDNGTSVKMDQHRGFLHNQAKNLLCGFYGR*HAELRFLDLV*

*PSLQLDPAQIYRVTWFISWSPCFSWGC*AGEVRAFLQENTHVRLRIFAARIYDYDPLYKEALQMLRDAGAQVSIMTYDEF

KHCWDTFVDHQGCPFQPWDGLDEHSQALSGRLRAILQNGN (italic: nucleic acid editing domain)

*Rhesus macaque* APOBEC-3A:
(SEQ ID NO: 48)
MDGSPASRPRHLMDPNTFTFNFNNDLSVRGRHQTYLCYEVERLDNGTWVPMDERRGFLCNKAKNVPCGDYGC*HVELRFL*

*CEVPSWQLDPAQTYRVTWFISWSPC*FRRGCAGQVRVFLQENKHVRLRIFAARIYDYDPLYQEALRTLRDAGAQVSIMTY

EEFKHCWDTFVDRQGRPFQPWDGLDEHSQALSGRLRAILQNGN (italic: nucleic acid editing domain)

Bovine APOBEC-3A:
(SEQ ID NO: 49)
MDEYTFTENFNNQGWPSKTYLCYEMERLDGDATIPLDEYKGFVRNKGLDQPEKPC*HAELYFLGKIHSWNLDRNQHYRLT*

*CFISWSPC*YDCAQKLTTFLKENHHISLHILASRIYTHNRFGCHQSGLCELQAAGARITIMTFEDFKHCWETFVDHKGKP

FQPWEGLNVKSQALCTELQAILKTQQN (italic: nucleic acid editing domain)

Human APOBEC-3H:
(SEQ ID NO: 50)
MALLTAETFRLQFNNKRRLRRPYYPRKALLCYQLTPQNGSTPTRGYFENKKKC*HAEICFINEIKSMGLDETQCYQVTCY*

*LTWSPCSSC*AWELVDFIKAHDHLNLGIFASRLYYHWCKPQQKGLRLLCGSQVPVEVMGFPKFADCWENFVDHEKPLSFN

PYKMLEELDKNSRAIKRRLERIKIPGVRAQGRYMDILCDAEV (italic: nucleic acid editing domain)

*Rhesus macaque* APOBEC-3H:
(SEQ ID NO: 51)
MALLTAKTFSLQFNNKRRVNKPYYPRKALLCYQLTPQNGSTPTRGHLKNKKKDHAEIRFINKIKSMGLDETQCYQVTCY

LTWSPCPSCAGELVDFIKAHRHLNLRIFASRLYYHWRPNYQEGLLLLCGSQVPVEVMGLPEFTDCWENFVDHKEPPSFN

PSEKLEELDKNSQAIKRRLERIKSRSVDVLENGLRSLQLGPVTPSSSIRNSR

Human APOBEC-3D:

(SEQ ID NO: 52)
MNPQIRNPMERMYRDTFYDNFENEPILYGRSYTWLCYEVKIKRGRSNLLWDTGVFRGPVLPKRQSNHRQEVYFRFEN*HA*
*EMCFLSWFCGNRLPANRRFQITWFVSWNPC*LPCVVKVTKFLAEHPNVTLTISAARLYYYRDRDWRWVLLRLHKAGARVK
IMDYEDFAYCWENFVCNEGQPFMPWYKFDDNYASLHRTLKEILRNPMEAMYPHIFYFHFKNLLKACGRNESWLCFTMEV
TKHHSAVFRKRGVFRNQVDPETHC*HAERCFLSWFCDDILSPNTNYEVTWYTSWSPCPEC*AGEVAEFLARHSNVNLTIFT
ARLCYFWDTDYQEGLCSLSQEGASVKIMGYKDFVSCWKNFVYSDDEPFKPWKGLQINFRLLKRRLREILQ (italic: nucleic acid editing domain)

Human APOBEC-1:

(SEQ ID NO: 53)
MTSEKGPSTGDPTLRRRIEPWEFDVFYDPRELRKEACLLYEIKWGMSRKIWRSSGKNTINHVEVNFIKKFTSERDFHPS
MSCSITWFLSWSPCWECSQAIREFLSRHPGVTLVIYVARLFWHMDQQNRQGLRDLVNSGVTIQIMRASEYYHCWRNFVN
YPPGDEAHWPQYPPLWMMLYALELHCIILSLPPCLKISRRWQNHLTFFRLHLQNCHYQTIPPHILLATGLIHPSVAWR

Mouse APOBEC-1:

(SEQ ID NO: 54)
MSSETGPVAVDPTLRRRIEPHEFEVFFDPRELRKETCLLYEINWGGRHSVWRHTSQNTSNHVEVNFLEKFTTERYFRPN
TRCSITWFLSWSPCGECSRAITEFLSRHPYVTLFIYIARLYHHTDQRNRQGLRDLISSGVTIQIMTEQEYCYCWRNFVN
YPPSNEAYWPRYPHLWVKLYVLELYCIILGLPPCLKILRRKQPQLTFFTITLQTCHYQRIPPHLLWATGLK

Rat APOBEC-1:

(SEQ ID NO: 55)
MSSETGPVAVDPTLRRRIEPHEFEVFFDPRELRKETCLLYEINWGGRHSIWRHTSQNTNKHVEVNFIEKFTTERYFCPN
TRCSITWFLSWSPCGECSRAITEFLSRYPHVTLFIYIARLYHHADPRNRQGLRDLISSGVTIQIMTEQESGYCWRNFVN
YSPSNEAHWPRYPHLWVRLYVLELYCIILGLPPCLNILRRKQPQLTFFTIALQSCHYQRLPPHILWATGLK

Human APOBEC-2:

(SEQ ID NO: 56)
MAQKEEAAVATEAASQNGEDLENLDDPEKLKELIELPPFEIVTGERLPANFFKFQFRNVEYSSGRNKTFLCYVVEAQGK
GGQVQASRGYLEDEHAAAHAEEAFFNTILPAFDPALRYNVTWYVSSSPCAACADRIIKTLSKTKNLRLLILVGRLFMWE
EPEIQAALKKLKEAGCKLRIMKPQDFEYVWQNFVEQEEGESKAFQPWEDIQENFLYYEEKLADILK

Mouse APOBEC-2:

(SEQ ID NO: 57)
MAQKEEAAEAAAPASQNGDDLENLEDPEKLKELIDLPPFEIVTGVRLPVNFFKFQFRNVEYSSGRNKTFLCYVVEVQSK
GGQAQATQGYLEDEHAGAHAEEAFFNTILPAFDPALKYNVTWYVSSSPCAACADRILKTLSKTKNLRLLILVSRLFMWE
EPEVQAALKKLKEAGCKLRIMKPQDFEYIWQNFVEQEEGESKAFEPWEDIQENFLYYEEKLADILK

Rat APOBEC-2:

(SEQ ID NO: 58)
MAQKEEAAEAAAPASQNGDDLENLEDPEKLKELIDLPPFEIVTGVRLPVNFFKFQFRNVEYSSGRNKTFLCYVVEAQSK
GGQVQATQGYLEDEHAGAHAEEAFFNTILPAFDPALKYNVTWYVSSSPCAACADRILKTLSKTKNLRLLILVSRLFMWE
EPEVQAALKKLKEAGCKLRIMKPQDFEYLWQNFVEQEEGESKAFEPWEDIQENFLYYEEKLADILK

Bovine APOBEC-2:

(SEQ ID NO: 59)
MAQKEEAAAAAEPASQNGEEVENLEDPEKLKELIELPPFEIVTGERLPAHYFKFQFRNVEYSSGRNKTFLCYVVEAQSK
GGQVQASRGYLEDEHATNHAEEAFFNSIMPTFDPALRYMVTWYVSSSPCAACADRIVKTLNKTKNLRLLILVGRLFMWE
EPEIQAALRKLKEAGCRLRIMKPQDFEYIWQNFVEQEEGESKAFEPWEDIQENFLYYEEKLADILK

*Petromyzon marinus* CDA1 (pmCDA1)

(SEQ ID NO: 60)
MTDAEYVRIHEKLDIYTFKKQFFNNKKSVSHRCYVLFELKRRGERRACFWGYAVNKPQSGTERGIHAEIFSIRKVEEYL
RDNPGQFTINWYSSWSPCADCAEKILEWYNQELRGNGHTLKIWACKLYYEKNARNQIGLWNLRDNGVGLNVMVSEHYQC
CRKIFIQSSHNQLNENRWLEKTLKRAEKRRSELSFMIQVKILHTTKSPAV

-continued

Human APOBEC3G D316R D317R
(SEQ ID NO: 61)
MKPHFRNTVERMYRDTFSYNFYNRPILSRRNTVWLCYEVKTKGPSRPPLDAKIFRGQVYSELKYHPEMRFFHWFSKWRK

LHRDQEYEVTWYISWSPCTKCTRDMATFLAEDPKVTLTIFVARLYYFWDPDYQEALRSLCQKRDGPRATMKFNYDEFQH

CWSKFVYSQRELFEPWNNLPKYYILLHFMLGEILRHSMDPPTFTFNFNNEPWVRGRHETYLCYEVERMHNDTWVLLNQR

RGFLCNQAPHKHGFLEGRHAELCFLDVIPFWKLDLDQDYRVTCFTSWSPCFSCAQEMAKFISKKHVSLCIFTARIYRRQ

GRCQEGLRTLAEAGAKISFTYSEFKHCWDTFVDHQGCPFQPWDGLDEHSQDLSGRLRAILQNQEN

Human APOBEC3G chain A
(SEQ ID NO: 62)
MDPPTFTFNFNNEPWWGRHETYLCYEVERMHNDTWVLLNQRRGFLCNQAPHKHGFLEGRHAELCFLDVIPFWKLDLDQD

YRVTCFTSWSPCFSCAQEMAKFISKNKHVSLCIFTARIYDDQGRCQEGLRTLAEAGAKISFTYSEFKHCWDTFVDHQGC

PFQPWDGLDEHSQDLSGRLRAILQ

Human APOBEC3G chain A D120R D121R
(SEQ ID NO: 63)
MDPPTFTFNFNNEPWVRGRHETYLCYEVERMHNDTWVLLNQRRGFLCNQAPHKHGFLEGRHAELCFLDVIPFWKLDLDQ

DYRVTCFTSWSPCFSCAQEMAKFISKNKHVSLCIFTARIYRRQGRCQEGLRTLAEAGAKISFMTYSEFKHCWDTFVDHQ

GCPFQPWDGLDEHSQDLSGRLRAILQ

The term "deaminase" or "deaminase domain" refers to a protein or fragment thereof that catalyzes a deamination reaction.

"Detect" refers to identifying the presence, absence or amount of the analyte to be detected. In one embodiment, a sequence alteration in a polynucleotide or polypeptide is detected. In another embodiment, the presence of indels is detected.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "disease" is meant any condition or disorder that damages or interferes with the normal function of a cell, tissue, or organ. In particular embodiments, a disease amenable to treatment with compositions of the invention is associated with a point mutation, a splicing event, a premature stop codon, or a misfolding event.

By "DNA binding protein domain" is meant a polypeptide or fragment thereof that binds DNA. In some embodiments, the DNA binding protein domain is a Zinc Finger or TALE domain having sequence specific DNA binding activity. In other embodiments, the DNA binding protein domain is a domain of a CRISPR-Cas protein (e.g., Cas9) that binds DNA, including, for example, that binds a protospacer adjacent motif (PAM). In some embodiments, the DNA binding protein domain forms a complex with a polynucleotide (e.g., single-guide RNA), and the complex binds DNA sequences specified by a gRNA and a protospacer adjacent motif. In some embodiments, the DNA binding protein domain comprises nickase activity (e.g., nCas9) or is catalytically inactive (e.g., dCas9, Zinc finger domain, TALE). In still other embodiments, the DNA binding protein domain is a catalytically inactive variant of the homing endonuclease I-SceI or the DNA-binding domain of the TALE protein AvrBs4. See, for example, Gabsalilow et al., Nucleic Acids Research, Volume 41, Issue 7, 1 Apr. 2013, Pages e83. In some embodiments, a DNA binding protein domain is fused to a domain having catalytic activity (e.g., FokI, MutH). In particular embodiments, a Zinc finger domain is fused to a catalytic domain of the endonuclease FokI. In other embodiments, a TALE is fused to MutH, which comprises site-specific DNA nicking activity.

The term "effective amount," as used herein, refers to an amount of a biologically active agent that is sufficient to elicit a desired biological response. In some embodiments, an effective amount of a fusion protein provided herein, e.g., of a nucleobase editor comprising a napDNAbp domain having nickase activity, a catalytically inactive napDNAbp, and a nucleobase editor domain (e.g., adenosine deaminase, cytidine deaminase) may refer to the amount of the fusion protein that is sufficient to induce editing of a target site specifically bound by the nucleobase editor. As will be appreciated by the skilled artisan, the effective amount of an agent, e.g., a fusion protein may vary depending on various factors as, for example, on the desired biological response, e.g., on the specific allele, genome, or target site to be edited, on the cell or tissue being targeted, and on the agent being used.

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

"Heterologous" means derived from a distinct entity from the rest of the entity to which it is being compared to, for example, a polynucleotide or a polypeptide derived from, an organism, a cell, or a protein of another genetic, structural, or functional background of the same species or different species. In some embodiments, two heterologous polypeptides or polynucleotides may be derived from different species. In some embodiments, two heterologous polypeptide or polynucleotide may be derived from the same species and perform distinct functions. In some embodiments, two heterologous DNA binding protein domain may each recognize a different binding-associated sequence, e.g. a PAM sequence.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

The term "inhibitor of base repair" or "IBR" refers to a protein that is capable in inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGGI, hNEILI, T7 EndoI, T4PDG, UDG, hSMUGI, and hAAG. In some embodiments, the IBR is an inhibitor of Endo V or hAAG. In some embodiments, the IBR is a catalytically inactive EndoV or a catalytically inactive hAAG.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker," as used herein, refers to a bond (e.g., covalent bond), chemical group, or a molecule linking two molecules or moieties, e.g., two domains of a fusion protein. In one embodiment, a fusion protein of the invention comprises linkers that join a nuclease-inactive Cas9 domain, a nuclease-active Cas9 domain, and a nucleic acid-editing domain (e.g., a deaminase). In some embodiments, linkers join each of the three domains of a fusion protein of the invention, such as, for example, a nuclease-inactive Cas9 domain, a nuclease active Cas9 domain, and a nucleic acid-editing domain (e.g., an adenosine deaminase, cytidine deaminase). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated. In some embodiments, a linker comprises the amino acid sequence SGSETPGTSESATPES (SEQ ID NO: 64), which may also be referred to as the XTEN linker. In some embodiments, a linker comprises the amino acid sequence SGGS (SEQ ID NO: 65). In some embodiments, a linker comprises (SGGS)$_n$ (SEQ ID NO: 66), (GGGS)$_n$ (SEQ ID NO: 67), (GGGGS)$_n$ (SEQ ID NO: 68), (G)$_n$ (SEQ ID NO: 69), (EAAAK)$_n$ (SEQ ID NO: 70), (GGS)$_n$ (SEQ ID NO: 71), SGSETPGTSESATPES (SEQ ID NO: 64), or (XP)$_n$ motif (SEQ ID NO: 72), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

In some embodiments, the domains of the nucleobase editor are fused via a linker that comprises the amino acid sequence of SGGSSGSETPGTSESATPESSGGS (SEQ ID NO: 73), SGGSSGGSSGSETPGTSESATPESSGGSSGGS (SEQ ID NO: 74), or GGSGGSPGSPAGSPTSTEEGTS-ESATPESGPGTSTEPSEGSAPGSPAGSPTSTEEGTSTE PSEGSAPGTSTEPSEGSAPGTSESAT-PESGPGSEPATSGGSGGS (SEQ ID NO: 75). In some embodiments, domains of the nucleobase editor are fused via a linker comprising the amino acid sequence SGSETPGTSESATPES (SEQ ID NO: 64), which may also be referred to as the XTEN linker. In some embodiments, the linker is 24 amino acids in length. In some embodiments, the linker comprises the amino acid sequence SGGSSGGSSG-SETPGTSESATPES (SEQ ID NO: 76). In some embodiments, the linker is 40 amino acids in length. In some embodiments, the linker comprises the amino acid sequence SGGSSGGSSGSETPGTSESAT-PESSGGSSGGSSGGSSGGS (SEQ ID NO: 77). In some embodiments, the linker is 64 amino acids in length. In some embodiments, the linker comprises the amino acid sequence SGGSSGGSSGSETPGTSESAT-PESSGGSSGGSSGGSSGGSSGSETPGTSESAT- PESSGGS SGGS (SEQ ID NO: 78). In some embodiments, the linker is 92 amino acids in length. In some embodiments, the linker comprises the amino acid sequence (SEQ ID NO: 79)
PGSPAGSPTSTEEGTSESATPESGPGTSTEPSEGSAPGSPAGSPTSTEEG

TSTEPSEGSAPGTSTEPSEGSAPGTSESATPESGPGSEPATS.

By "marker" is meant any protein or polynucleotide having an alteration in expression level or activity that is associated with a disease or disorder.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, IRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (2'—e.g., fluororibose, ribose, 2'-deoxyribose, arabinose, and hexose); and/or modified phosphate groups (e.g., phosphorothioates and 5'-N-phosphoramidite linkages).

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 80), KRPAATKKAGQAKKKK (SEQ ID NO: 81), KKTELQTTNAENKTKKL (SEQ ID NO: 82), KRGIN-DRNFWRGENGRKTR (SEQ ID NO: 83), RKSGKIAAIV-VKRPRK (SEQ ID NO: 84), PKKKRKV (SEQ ID NO: 85), or MDSLLMNRRKFLYQFKNVRWAKGRRETYLC (SEQ ID NO: 86).

The term "nucleic acid programmable DNA binding protein" or "napDNAbp" refers to a protein that associates with a nucleic acid (e.g., DNA or RNA), such as a guide nucleic acid, that guides the napDNAbp to a specific nucleic acid sequence. For example, a Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, and C2c3. Other nucleic acid programmable DNA binding proteins are also within the scope of this disclosure, although they may not be specifically listed in this disclosure.

As used herein, "obtaining" as in "obtaining an agent" includes synthesizing, purchasing, or otherwise acquiring the agent.

"Patient" or "subject" as used herein refers to a subject, e.g., a mammalian subject diagnosed with or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, goats, sheep, rodents (e.g., mice, rabbits, rats, or guinea pigs) and other mammalians that can benefit from the therapies disclosed herein. Exemplary human patients can be male and/or female. "Patient in need thereof" or "subject in need thereof" is referred to herein as a patient diagnosed with or suspected of having a disease or disorder.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et ah, Science 337:816-821 (2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRIS PR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., Mclaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607 (2011).

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, the activity of a nucleobase editor fusion protein comprising an nCas9 domain, a dCas9 gRNA binding domain, and a deaminase domain is compared to the activity of a reference fusion protein comprising a deaminase and a single Cas9 domain having nickase activity and gRNA binding activity.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, more at least about 25 amino acids, and even more preferably about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, and about 100 nucleotides or about 300 nucleotides or any integer thereabout or therebetween.

The term "single nucleotide polymorphism (SNP)" is a variation in a single nucleotide that occurs at a specific position in the genome, where each variation is present to some appreciable degree within a population (e.g., >1%). For example, at a specific base position in the human genome, the C nucleotide can appear in most individuals, but in a minority of individuals, the position is occupied by an A. This means that there is a SNP at this specific position, and the two possible nucleotide variations, C or A, are said to be alleles for this position. SNPs underlie differences in susceptibility to disease. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs. Synonymous SNPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation can also be called a single-nucleotide alteration.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the invention, but which does not substantially recognize and bind other molecules in a sample, for example, a biological sample.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a one: embodiment, hybridization will occur at 30° C. in 750 mM NaCl, 75 mM trisodium citrate, and 1% SDS. In another embodiment, hybridization will occur at 37° C. in 500 mM NaCl, 50 mM trisodium citrate, 1% SDS, 35% formamide, and 100. μg/ml denatured salmon sperm DNA (ssDNA). In another embodiment, hybridization will occur at 42° C. in 250 mM NaCl, 25 mM trisodium citrate, 1% SDS, 50% formamide, and 200 μg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). In one embodiment, such a sequence is at least 60%, 80% or 85%, 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

By "subject" is meant a mammal, including, but not limited to, a human or non-human mammal, such as a bovine, equine, canine, ovine, or feline. Subjects include livestock, domesticated animals raised to produce labor and to provide commodities, such as food, including without limitation, cattle, goats, chickens, horses, pigs, rabbits, and sheep.

The term "target site" refers to a sequence within a nucleic acid molecule that is modified by a nucleobase editor. In one embodiment, the target site is deaminated by a deaminase or a fusion protein comprising a deaminase (e.g., cytidine or adenine deaminase).

Because RNA-programmable nucleases (e.g., Cas9) use RNA: DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et ah, Multiplex genome engineering using CRISPR/Cas systems. Science 339, 819-823 (2013); *Mali*, P. et ah, RNA-guided human genome engineering via Cas9. Science 339, 823-826 (2013); Hwang, W. Y. et ah, Efficient genome editing in zebrafish using a CRISPR-Cas system. Nature biotechnology 31, 227-229 (2013); Jinek, M. et ah, RNA-programmed genome editing in human cells. eLife 2, e00471 (2013); Dicarlo, J. E. et ah, Genome engineering in *Saccharomyces cerevisiae* using CRISPR-Cas systems. Nucleic acids research (2013); Jiang, W. et ah RNA-guided editing of bacterial genomes using CRISPR-Cas systems. Nature biotechnology 31, 233-239 (2013); the entire contents of each of which are incorporated herein by reference).

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

As used herein, the terms "treat," treating," "treatment," and the like refer to reducing or ameliorating a disorder and/or symptoms associated therewith. It will be appreciated that, although not precluded, treating a disorder or condition does not require that the disorder, condition or symptoms associated therewith be completely eliminated.

The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a modified version thereof. In some embodiments, the UGI proteins provided herein include fragments of UGI and proteins homologous to a UGI or a UGI fragment. For example, in some embodiments, a UGI domain comprises a fragment of the amino acid sequence set forth herein below. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or 100% of an exemplary UGI sequence provided herein. In some embodiments, a UGI comprises an amino acid sequence homologous to the amino acid sequence set forth herein below, or an amino acid sequence homologous to a fragment of the amino acid sequence set forth herein below. In some embodiments, proteins comprising UGI or fragments of UGI or homologs of UGI or UGI fragments are referred to as "UGI variants." A UGI variant shares homology to UGI, or a fragment thereof. For example, a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth herein. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth below. In some embodiments, the UGI comprises the following amino acid sequence:

```
>sp1P14739IUNGI_BPPB2 Uracil-DNA glycosylase
inhibitor
                                  (SEQ ID NO: 87)
MTNLSDIIEKETGKQLVIQESILMLPEEVEEVIGNKPESDILVHTAYDES

TDENVMLLT S D APE YKPW ALVIQDS NGENKIKML
```

Unless specifically stated or obvious from context, as used herein, the term "or" is understood to be inclusive. Unless specifically stated or obvious from context, as used herein, the terms "a", "an", and "the" are understood to be singular or plural.

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

DETAILED DESCRIPTION OF THE INVENTION

The invention features compositions and methods for modifying a polynucleotide (e.g., DNA) using a nucleobase editor containing a first DNA binding protein domain that is catalytically inactive, a domain having base editing activity, and a second DNA binding protein domain having nickase activity, where the DNA binding protein domains are expressed on a single fusion protein or are expressed separately (e.g., on separate expression vectors). The invention also features a fusion protein comprising a domain having base editing activity (e.g., cytidine deaminase or adenosine deaminase), and two nucleic acid programmable DNA binding protein domains (napDNAbp), a first comprising nickase activity and a second napDNAbp that is catalytically inactive, wherein at least the two napDNAbp are joined by a linker. In one embodiment, the fusion protein comprises a DNA binding domain of a CRISPR-Cas protein (e.g., Cas9) having nickase activity (nCas), a catalytically inactive domain of a CRISPR-Cas protein (e.g., Cas9) having nucleic acid programmable DNA binding activity (dCas), and a deaminase domain, wherein the dCas is joined to the nCas by a linker, and the dCas is immediately adjacent to the deaminase domain, as well as related methods for using such editors, and kits comprising the editors.

In particular embodiments, the invention features a nucleobase editor fusion protein comprising a domain having base editing activity (e.g., deaminase activity), and two nucleic acid programmable DNA binding protein domains (napDNAbp), where one of the napDNAbp domains has nickase activity and the other napDNAbp is catalytically inactive, and where at least the two napDNAbp are joined by a linker, thereby forming a nucleobase editor fusion protein capable of inducing mutations in a target nucleic acid molecule, but generating a reduced number of indels relative to a reference nucleobase editor comprising a single napDNAbp domain having nickase activity and gRNA binding activity. In one embodiment, the fusion protein comprises a nucleobase editing domain (e.g., deaminase) fused to a gRNA binding domain of a CRISPR-Cas protein (e.g., Cas9), and a DNA cleavage domain of a CRISPR-Cas protein (e.g., Cas9), where a linker joins at least the two domains of the CRISPR-Cas proteins.

Nucleobase editors of the invention are fusion proteins that are useful inter alia for targeted editing of nucleic acid sequences. Such fusion proteins may be used for targeted editing of DNA in vitro, e.g., to introduce mutations that alter the activity of a regulatory sequence, for example, or that alter the activity of an encoded protein.

Adenosine Deaminases

In some embodiments, the fusion proteins of the invention comprise an adenosine deaminase domain. In some embodiments, the adenosine deaminases provided herein are capable of deaminating adenine. In some embodiments, the adenosine deaminases provided herein are capable of deaminating adenine in a deoxyadenosine residue of DNA. The adenosine deaminase may be derived from any suitable organism (e.g., E. coli). In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

In one embodiment, a fusion protein of the invention comprises a wild-type TadA linked to TadA7.10, which is linked to a catalytically inactive CRISPR-Cas protein (e.g., Cas9) or a CRISPR-Cas nickase. In the ABE7.10 editor TadA7.10 and TadA (wt) are capable of heterodimerization. The relevant sequences follow:

```
TadA(wt):
                                        (SEQ ID NO: 88)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD

TadA7.10:
                                        (SEQ ID NO: 89)
SEVEFSHEYWMRHALTLAKRARDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

PRQVFNAQKKAQSSTD
```

In some embodiments, the TadA (e.g., having double-stranded substrate activity) or TadA7.10 is provided as a homodimer or as a monomer.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments, the adenosine deaminase comprises a D108X mutation in the TadA reference sequence, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in TadA reference sequence, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase.

In some embodiments, the adenosine deaminase comprises a E155X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase.

In some embodiments, the adenosine deaminase comprises a D147X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase.

It should be appreciated that any of the mutations provided herein (e.g., based on the ecTadA amino acid sequence of TadA reference sequence) may be introduced into other adenosine deaminases, such as *S. aureus* TadA (saTadA), or other adenosine deaminases (e.g., bacterial adenosine deaminases). It would be apparent to the skilled artisan how to are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in TadA reference sequence, or a corresponding mutation in another adenosine deaminase. In some embodiments, an adenosine deaminase comprises the following group of mutations (groups of mutations are separated by a ";") in TadA reference sequence, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D 147Y; and D108N, A106V, E55V, and D147Y. It should be appreciated, however, that any combination of corresponding mutations provided herein may be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95I, V102A, F104L, A106V, R107C, or R107H, or R107P, D108G, or D108N, or D108V, or D108A, or D108Y, K1101, MI18K, N127S, A138V, F149Y, M151V, R153C, Q154L, I156D, and/or K157R mutation in TadA reference sequence, or one or more corresponding mutations in another adenosine deaminase.

In some embodiments, the adenosine deaminase comprises one or more of H8X, D108X, and/or N127X mutation in TadA reference sequence, or one or more corresponding mutations in another adenosine deaminase, where X indicates the presence of any amino acid. In some embodiments, the adenosine deaminase comprises one or more of a H8Y, D108N, and/or N127S mutation in TadA reference sequence, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase. In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V in TadA reference sequence, or a corresponding mutation or mutations in another adenosine deaminase. In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase.

In some embodiments, the adenosine deaminase comprises one or more of the or one or more corresponding mutations in another adenosine deaminase. In some embodiments, the adenosine deaminase comprises a D108N, D108G, or D108V mutation in TadA reference sequence, or corresponding mutations in another adenosine deaminase. In some embodiments, the adenosine deaminase comprises a A106V and D108N mutation in TadA reference sequence, or corresponding mutations in another adenosine deaminase. In some embodiments, the adenosine deaminase comprises R107C and D108N mutations in TadA reference sequence, or corresponding mutations in another adenosine deaminase. In some embodiments, the adenosine deaminase comprises a H8Y, D108N, N127S, D147Y, and Q154H mutation in TadA reference sequence, or corresponding mutations in another adenosine deaminase. In some embodiments, the adenosine deaminase comprises a H8Y, R24W, D108N, N127S, D147Y, and E155V mutation in TadA reference sequence, or corresponding mutations in another adenosine deaminase. In some embodiments, the adenosine deaminase comprises a D108N, D147Y, and E155V mutation in TadA reference sequence, or corresponding mutations in another adenosine deaminase. In some embodiments, the adenosine deaminase comprises a H8Y, D108N, and S 127S mutation in TadA reference sequence, or corresponding mutations in another adenosine deaminase. In some embodiments, the adenosine deaminase comprises a A106V, D108N, D147Y and E155V mutation in TadA reference sequence, or corresponding mutations in another adenosine deaminase.

In some embodiments, the adenosine deaminase comprises one or more of a, S2X, H8X, I49X, L84X, H123X, N127X, I156X and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, 149F, L84F, H123Y, N127S, I156F and/or K160S mutation in TadA reference sequence, or one or more corresponding mutations in another adenosine deaminase.

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase.

In some embodiments, the adenosine deaminase comprises an H123X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase.

In some embodiments, the adenosine deaminase comprises an 1157X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an 1157F mutation in TadA reference sequence, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and 1156X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, 149X, A106X, D108X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in TadA reference sequence, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in TadA reference sequence.

In some embodiments, the adenosine deaminase comprises one, two, three, four, or five, mutations selected from the group consisting of H8Y, A106T, D108N, N127S, and K160S in TadA reference sequence, or a corresponding mutation or mutations in another adenosine deaminase.

In some embodiments, the adenosine deaminase comprises one or more of a E25X, R26X, R107X, A142X, and/or A143X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in TadA reference sequence, or one or more corresponding mutations in another adenosine deaminase. In some embodiments, the adenosine deaminase comprises one or more of the mutations described herein corresponding to TadA reference sequence, or one or more corresponding mutations in another adenosine deaminase.

In some embodiments, the adenosine deaminase comprises an E25X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase.

In some embodiments, the adenosine deaminase comprises an R26X mutation in TadA reference sequence, or a corresponding mutation in another adenosine deaminase, where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase.

In some embodiments, the adenosine deaminase comprises an R107X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation in TadA reference sequence, or a corresponding mutation in another adenosine deaminase.

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase.

In some embodiments, the adenosine deaminase comprises an A143X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in TadA reference sequence, or a corresponding mutation in another adenosine deaminase.

In some embodiments, the adenosine deaminase comprises one or more of a H36X, N37X, P48X, I49X, R51X, M70X, N72X, D77X, E134X, S 146X, Q154X, K157X, and/or K161X mutation in TADA REFERENCE SEQUENCE, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S 146R, S 146C, Q154H, K157N, and/or K161T mutation in TadA reference sequence, or one or more corresponding mutations in another adenosine deaminase.

In some embodiments, the adenosine deaminase comprises an H36X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase.

In some embodiments, the adenosine deaminase comprises an N37X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an N37T, or N37S mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an P48T, or P48L mutation in TadA reference sequence, or a corresponding mutation in another adenosine deaminase.

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation in TadA reference sequence, or a corresponding mutation in another adenosine deaminase.

In some embodiments, the adenosine deaminase comprises an S 146X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an S 146R, or S 146C mutation in TadA reference sequence, or a corresponding mutation in another adenosine deaminase.

In some embodiments, the adenosine deaminase comprises an K157X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase.

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase.

In some embodiments, the adenosine deaminase comprises an W23X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a W23R, or W23L mutation in TadA reference sequence, or a corresponding mutation in another adenosine deaminase.

In some embodiments, the adenosine deaminase comprises an R152X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a R152P, or R52H mutation in TadA reference sequence, or a corresponding mutation in another adenosine deaminase.

In one embodiment, the adenosine deaminase may comprise the mutations H36L, R51L, L84F, A106V, D108N, H123Y, S 146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses: (A106V_D108N), (R107C_D108N), (H8Y_D108N_S 127S_D 147Y_Q154H), (H8Y_R24W_D108N_N127S_D147Y_E155V), (D108N_D147Y_E155V), (H8Y_D108N_S 127S), (H8Y_D108N_N127S_D147Y_Q154H), (A106V_D108N_D147Y_E155V) (D108Q_D147Y_E155V) (D108M_D147Y_E155V), (D108L_D147Y_E155V), (D108K_D147Y_E155V), (D108I_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_I156Y), (L84F_A106V_D108N_H123Y_D147Y_E155V_I156F), (D103A_D014N), (G22P_D 103 A_D 104N), (G22P_D 103 A_D 104N_S 138 A), (D 103 A_D 104N_S 138A), (R26G_L84F_A106V_R107H_D108N_H123Y_A142N_A143D_D147Y_E155V_I156F),
(E25G_R26G_L84F_A106V_R107H_D108N_H123Y_A142N_A143D_D147Y_E155V_I156F),
(E25D_R26G_L84F_A106V_R107K_D108N_H123Y_A142N_A143G_D147Y_E155V_I156F),
(R26Q_L84F_A106V_D108N_H123Y_A142N_D147Y_E155V_I156F),
(E25M_R26G_L84F_A106V_R107P_D108N_H123Y_A142N_A143D_D147Y_E155V_I156F),
(R26C_L84F_A106V_R107H_D108N_H123Y_A142N_D147Y_E155V_I156F),
(L84F_A106V_D108N_H123Y_A142N_A143L_D147Y_E155V_I156F),
(R26G_L84F_A106V_D108N_H123Y_A142N_D147Y_E155V_I156F),
(E25A_R26G_L84F_A106V_R107N_D108N_H123Y_A142N_A143E_D147Y_E155V_I156F)
(R26G_L84F_A106V_R107H_D108N_H123Y_A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_A143G_D147Y_E155V),
(R26G_A106V_D108N_R107H_A142N_A143D_D147Y_E155V),
(E25D_R26G_A106V_D108N_A142N_D147Y_E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_H123Y_S146C_D147Y_E155V_I156F_K157N),
(N37T_P48T_M70L_L84F_A106V_D108N_H123Y_D147Y_149V_E155V_I156F),
(N37S_L84F_A106V_D108N_H123Y_D147Y_E155V_I156F_K161T),
(H36L_L84F_A106V_D108N_H123Y_D147Y_Q154H_E155V_I156F), (N72S_L84F_A106V_D108N_H123Y_S146R_D147Y_E155V_I156F),
(H36L_P48L_L84F_A106V_D108N_H123Y_E134G_D147Y_E155V_I156F),
(H36L_L84F_A106V_D108N_H123Y_S146C_D147Y_E155V_I156F),
(L84F_A106V_D108N_H123Y_S146R_D147Y_E155V_I156F_K161T),
(N37S_R51H_D77G_L84F_A106V_D108N_H123Y_D147Y_E155V_I156F),
(R51L_L84F_A106V_D108N_H123Y_D147Y_E155V_I156F_K157N),
(D24G_Q71R_L84F_H96L_A106V_D108N_H123Y_D147Y_E155V_I156F_K160E),
(H36L_G67V_L84F_A106V_D108N_H123Y_S146T_D147Y_E155V_I156F),
(Q71L_L84F_A106V_D108N_H123Y_L137M_A143E_D147Y_E155V_I156F),
(E25G_L84F_A106V_D108N_H123Y_D147Y_E155V_I156F_Q159L),
(L84F_A91T_F104I_A106V_D108N_H123Y_D147Y_E155V_I156F),
(N72D_L84F_A106V_D108N_H123Y_G125A_D147Y_E155V_I156F),
(P48S_L84F_S97C_A106V_D108N_H123Y_D147Y_E155V_I156F),
(W23G_L84F_A106V_D108N_H123Y_D147Y_E155V_I156F),
(D24G_P48L_Q71R_L84F_A106V_D108N_H123Y_D147Y_E155V_I156F_Q159L),
(L84F_A106V_D108N_H123Y_A142N_D147Y_E155V_I156F),
(H36L_R51L_L84F_A106V_D108N_H123Y_A142N_S146C_D147Y_E155V_I156F_K157N),
(N37S_L84F_A106V_D108N_H123Y_A142N_D147Y_E155V_I156F_K161T),
(L84F_A106V_D108N_D147Y_E155V_I156F),
(R51L_L84F_A106V_D108N_H123Y_S146C_D147Y_E155V_I156F_K157N_K161T),
(L84F_A106V_D108N_H123Y_S146C_D147Y_E155V_I156F_K161T),
(L84F_A106V_D108N_H123Y_S146C_D147Y_E155V_I156F_K157N_K160E_K161T),
(L84F_A106V_D108N_H123Y_S146C_D147Y_E155V_I156F_K157N_K160E), (R74Q_L84F_A106V_D108N_H123Y_D147Y_E155V_I156F),
(R74A_L84F_A106V_D108N_H123Y_D147Y_E155V_I156F),
(L84F_A106V_D108N_H123Y_D147Y_E155V_I156F),
(R74Q_L84F_A106V_D108N_H123Y_D147Y_E155V_I156F),
(L84F_R98Q_A106V_D108N_H123Y_D147Y_E155V_I156F),
(L84F_A106V_D108N_H123Y_R129Q_D147Y_E155V_I156F),
(P48S_L84F_A106V_D108N_H123Y_A142N_D147Y_E155V_I156F), (P48S_A142N),
(P48T_149V_L84F_A106V_D108N_H123Y_A142N_D147Y_E155V_I156F_L157N), (P48T_149V_A142N),
(H36L_P48S_R51L_L84F_A106V_D108N_H123Y_S146C_D147Y_E155V_I156F K157N),
(H36L_P48S_R51L_L84F_A106V_D108N_H123Y_S146C_A142N_D147Y_E155V_I156F
(H36L_P48T_149V_R51L_L84F_A106V_D108N_H123Y_S146C_D147Y_E155V_I156F K157N),
(H36L_P48T_149V_R51L_L84F_A106V_D108N_H123Y_A142N_S146C_D147Y_E155V_I156F_K157N),
(H36L_P48A_R51L_L84F_A106V_D108N_H123Y_S146C_D147Y_E155V_I156F K157N),
(H36L_P48A_R51L_L84F_A106V_D108N_H123Y_A142N_S146C_D147Y_E155V_I156F_K157N),
(H36L_P48A_R51L_L84F_A106V_D108N_H123Y_S146C_A142N_D147Y_E155V_I156F_K157N),
(W23L_H36L_P48A_R51L_L84F_A106V_D108N_H123Y_S146C_D147Y_E155V_I156F_K157N),
(W23R_H36L_P48A_R51L_L84F_A106V_D108N_H123Y_S146C_D147Y_E155V_I156F K157N),
(W23L_H36L_P48A_R51L_L84F_A106V_D108N_H123Y_S146R_D147Y_E155V_I156F K161T),
(H36L_P48A_R51L_L84F_A106V_D108N_H123Y_S146C_D147Y_R152H_E155V_I156F_K157N),
(H36L_P48A_R51L_L84F_A106V_D108N_H123Y_S146C_D147Y_R152P_E155V_I156F K157N),
(W23L_H36L_P48A_R51L_L84F_A106V_D108N_H123Y_S146C_D147Y_R152P_E155V_I156F_K157N),
(W23L_H36L_P48A_R51L_L84F_A106V_D108N_H123Y_A142A_S146C_D147Y_E155V_I156F_K157N),
(W23L_H36L_P48A_R51L_L84F_A106V_D108N_H123Y_A142A_S146C_D147Y_R152P_E155V_I156F_K157N),
(W23L_H36L_P48A_R51L_L84F_A106V_D108N_H123Y_S146R_D147Y_E155V_I156F K161T),
(W23R_H36L_P48A_R51L_L84F_A106V_D108N_H123Y_S146C_D147Y_R152P_E155V_I156F_K157N),
(H36L_P48A_R51L_L84F_A106V_D108N_H123Y_A142N_S146C_D147Y_R152P_E155V_I156F_K157N).

Cytidine Deaminase

In one embodiment, a fusion protein of the invention comprises a cytidine deaminase. In some embodiments, the cytidine deaminases provided herein are capable of deaminating cytosine or 5-methylcytosine to uracil or thymine. In some embodiments, the cytosine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

A fusion protein of the invention comprises a nucleic acid editing domain. In some embodiments, the nucleic acid editing domain can catalyze a C to U base change. In some embodiments, the nucleic acid editing domain is a deaminase domain. In some embodiments, the deaminase is a cytidine deaminase or an adenosine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deaminase is a human APOBEC3G. In some embodiments, the deaminase is a fragment of the human APOBEC3G. In some embodiments, the deaminase is a human APOBEC3G variant comprising a D316R D317R mutation. In some embodiments, the deaminase is a fragment of the human APOBEC3G and comprising mutations corresponding to the D316R D317R mutations. In some embodiments, the nucleic acid editing domain is at least 80%, at least 85%, at least 90%, at least 92%, at least 95%, at least 96%, at least 97%, at least 98%, at least 99%), or at least 99.5% identical to the deaminase domain of any deaminase described herein.

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

Other Nucleobase Editors

The invention provides for a nucleobase editor fusion protein where virtually any nucleobase editor known in the art can be substituted for a cytidine deaminase or adenosine deaminase domain in a fusion protein of the invention.

Cas9 domains of Nucleobase Editors

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124).

MDKKYSIGLAIGTNSVGWAVIT-
DEYKVPSKKFKVLGNTDRHSIKKNLIGALL-
FDSGE TAEATRLKRTARRRYTRRKNRI-
CYLQEIFSNEMAKVDDSFFHRLEESFLVEEDKKH
E RHPIFGNIVDEVAYHEKYPTIYHLRKKLVD-
STDKADLRLIYLALAHMIKFRGHFLIEG
DLNPDNSDVDKLFIQLVQTYNQLFEENPI-
NASGVDAKAILSARLSKSRRLENLIAQLP GEK-
KNGLFGNLIALSLGLTPNFKSNFDLAEDAKLQL-
SKDTYDDDLDNLLAQIGDQYA
DLFLAAKNLSDAILLSDILRVNTEITKAPLSAS-
MIKRYDEHHQDLTLLKALVRQQLPE KYKE-
IFFDQSKNGYAGYIDGGASQEEFYKFIK-
PILEKMDGTEELLVKLNREDLLRKQ
RTFDNGSIPHQIHLGELHAILRRQEDFYPFLKDN-
REKIEKILTFRIPYYVGPLARGNSRF AWMTRK-
SEETITPWNFEEVVDKGASAQSFIER-
MTNFDKNLPNEKVLPKHSLLYEYFT
VYNELTKVKYVTEGMRKPAFLSGEQK-
KAIVDLLFKTNRKVTVKQLKEDYFKKIECF
DSVEISGVEDRFNASLGTYHDLLKIIKDKDFLD-
NEENEDILEDIVLTLTLFEDREMIEE RLKTYAHL-
FDDKVMKQLKRRRYTGWGRLSRKLIN-
GIRDKQSGKTILDFLKSDGFAN
RNFMQLIHDDSLTFKEDIQKAQVSGQGDSLHE-
HIANLAGSPAIKKGILQTVKVVDEL
VKVMGRHKPENIVIEMARENQTTQKGQKNSR-
ERMKRIEEGIKELGSQILKEHPVENT QLQNEK-
LYLYYLQNGRDMYVDQELDINRLSDYDV-
DAIVPQSFLKDDSIDNKVLTRS
DKNRGKSDNVPSEEVVKKMKNYWRQLLNAK-
LITQRKFDNLTKAERGGLSELDKAG FIKRQLVE-
TRQITKHVAQILDSRMNTKYDENDKLI-
REVKVITLKSKLVSDFRKDFQFY
KVREINNYHHAHDAYLNAVVGTALIK-
KYPKLESEFVYGDYKVYDVRKMIAKSEQEI
GKATAKYFFYSNIMNFFKTEITLANGEIRKRPLI-
ETNGETGEIVWDKGRDFATVRKVL
SMPQVNIVKKTEVQTGGFSKESILPKRN-
SDKLIARKKDWDPKKYGGFDSPTVAYSVL
VVAKVEKGKSKKLKSVKELLGITIMERSSFEKN-
PIDFLEAKGYKEVKKDLIIKLPKYS LFE-
LENGRKRMLASAGELQKGNELALPSKYVNFLY-
LASHYEKLKGSPEDNEQKQLF
VEQHKHYLDEIIEQISEFSKRVILADANLDKVL-
SAYNKHRDKPIREQAENIIHLFTLTN LGAPAAF-
KYFDTTIDRKRYTSTKEVLDATLIHQSITGLY-
ETRIDLSQLGGD (SEQ ID NO: 18) (see, e.g., Qi et al., "Repurposing CRISPR as an RNA-guided platform for sequence-specific control of gene expression." *Cell.* 2013; 152 (5): 1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31 (9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

In one particular embodiment, the invention features nucleobase editor fusion proteins that comprise an nCas9 domain and a dCas9 domain, where each of the Cas9 domains has a different PAM specificity. Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example in a region comprising a target base that is upstream of the PAM. See e.g., Komor, A. C., et al., "Programmable editing of a target base in genomic DNA without double-stranded DNA cleavage" Nature 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference. Several PAM variants are described at Table 1 below:

TABLE 1

Cas9 proteins and corresponding PAM sequences

| Variant | PAM |
|---|---|
| spCas9 | NGG |
| spCas9-VRQR | NGA |
| spCas9-VRER | NGCG |
| SpCas9-MQKFRAER | NGC |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| SpyMacCas9 | NAA |
| Cpf1 | 5' (TTTV) |

In some embodiments, the PAM is NGC. In some embodiments, the NGC PAM is recognized by a Cas9 variant. In some embodiments, the NGC PAM variant includes one or more amino acid substitutions selected from D1135M, S1136Q, G1218K, E1219F, A1322R, D1332A, R1335E, and T1337R (collectively termed "MQKFRAER").

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

Exemplary SaCas9 sequence
(SEQ ID NO: 91)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKT)SDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG

Residue N579 above, which is underlined and in bold, maybe mutated (e.g., to a A579) to yield a SaCas9 nickase.

Exemplary SaCas9n sequence
(SEQ ID NO: 92)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

-continued

```
EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG
```

Residue A579 above, which can be mutated from N579 to yield a SaCas9 nickase, is underlined and in bold.

Exemplary SaKKH Cas9
(SEQ ID NO: 93)

```
KRNYILGLDIGITSVGYGIIDYETRDVIDAGVRLFKEANVENNEGRRSKR

GARRLKRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRKLINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYKNDLIKINGELYRVIGVNNDLLNRIEVNMIDITY

REYLENMNDKRPPHIKTIASKTQSIKKYSTDILGNLYEVKSKKHPQIIK

KG.
```

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and it italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1134X, a R1334X, and a T1336X mutation, or a corresponding mutation in any of the amino acid sequences provided herein, wherein X is any amino acid. In some embodiments, the SpCas9 domain comprises one or more of a D1134E, R1334Q, and T1336R mutation, or a corresponding mutation in any of the amino acid sequences provided herein. In some embodiments, the SpCas9 domain comprises a D1134E, a R1334Q, and a T1336R mutation, or corresponding mutations in any of the amino acid sequences provided herein. In some embodiments, the SpCas9 domain comprises one or more of a D1134X, a R1334X, and a T1336X mutation, or a corresponding mutation in any of the amino acid sequences provided herein, wherein X is any amino acid. In some embodiments, the SpCas9 domain comprises one or more of a D1134V, a R1334Q, and a T1336R mutation, or a corresponding mutation in any of the amino acid sequences provided herein. In some embodiments, the SpCas9 domain comprises a D1134V, a R1334Q, and a T1336R mutation, or corresponding mutations in any of the amino acid sequences provided herein. In some embodiments, the SpCas9 domain comprises one or more of a D1134X, a G1217X, a R1334X, and a T1336X mutation, or a corresponding mutation in any of the amino acid sequences provided herein, wherein X is any amino acid. In some embodiments, the SpCas9 domain comprises one or more of a D1134V, a G1217R, a R1334Q, and a T1336R mutation, or a corresponding mutation in any of the amino acid sequences provided herein. In some embodiments, the SpCas9 domain comprises a D1134V, a G1217R, a R1334Q, and a T1336R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

Exemplary SpCas9
(SEQ ID NO: 94)

```
DKKYSIGLDIGTNSVGWAVITDEYKVPSKKFKVLGNTDRHSIKKNLIGALLFDSGETAEATRLKRTARRRYTRRKN

RICYLQEIFSNEMAKVDDSFFHRLEESFLVEEDKKHERHPIFGNIVDEVAYHEKYPTIYHLRKKLVDSTDKADLRL
```

IYLALAHMIKFRGHFLIEGDLNPDNSDVDKLFIQLVQTYNQLFEENPINASGVDAKAILSARLSKSRRLENLIAQL

PGEKKNGLFGNLIALSLGLTPNFKSNFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSKNGYAGYIDGGASQEEFYKFIKPILE

KMDGTEELLVKLNREDLLRKQRTFDNGSIPHQIHLGELHAILRRQEDFYPFLKDNREKIEKILTFRIPYYVGPLAR

GNSRFAWMTRKSEETITPWNFEEVVDKGASAQSFIERMTNFDKNLPNEKVLPKHSLLYEYFTVYNELTKVKYVTEG

MRKPAFLSGEQKKAIVDLLFKTNRKVTVKQLKEDYFKKIECFDSVETSGVEDRFNASLGTYHDLLKIIKDKDFLDN

EENEDILEDIVLTLTLFEDREMIEERLKTYAHLFDDKVMKQLKRRRYTGWGRLSRKLINGIRDKQSGKTILDFLKS

DGFANRNFMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQELDINRLSDYD

VDHIVPQSFLKDDSIDNKVLTRSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKKDWDPKKYGGFDSPTVAY

SVLVVAKVEKGKSKKLKSVKELLGITIMERSSFEKNPIDFLEAKGYKEVKKDLIIKLPKYSLFELENGRKRMLASA

GELQKGNELALPSKYVNFLYLASHYEKLKGSPEDNEQKQLFVEQHKHYLDEIIEQISEFSKRVILADANLDKVLSA

YNKHRDKPIREQAENIIHLFTLTNLGAPAAFKYFDTTIDRKRYTSTKEVLDATLIHQSITGLYETRIDLSQLGGD

Exemplary SpCas9n (SEQ ID NO: 95)

DKKYSIGLAIGTNSVGWAVITDEYKVPSKKFKVLGNTDRHSIKKNLIGALLFDSGETAEATRLKRTARRRYTRRKN

RICYLQEIFSNEMAKVDDSFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAILSARLSKSRRLENLIAQL

PGEKKNGLFGNLIALSLGLTPNFKSNFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSKNGYAGYIDGGASQEEFYKFIKPILE

KMDGTEELLVKLNREDLLRKQRTFDNGSIPHQIHLGELHAILRRQEDFYPFLKDNREKIEKILTFRIPYYVGPLAR

GNSRFAWMTRKSEETITPWNFEEVVDKGASAQSFIERMTNFDKNLPNEKVLPKHSLLYEYFTVYNELTKVKYVTEG

MRKPAFLSGEQKKAIVDLLFKTNRKVTVKQLKEDYFKKIECFDSVETSGVEDRFNASLGTYHDLLKIIKDKDFLDN

EENEDILEDIVLTLTLFEDREMIEERLKTYAHLFDDKVMKQLKRRRYTGWGRLSRKLINGIRDKQSGKTILDFLKS

DGFANRNFMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQELDINRLSDYD

VDHIVPQSFLKDDSIDNKVLTRSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKKDWDPKKYGGFDSPTVAY

SVLVVAKVEKGKSKKLKSVKELLGITIIVIERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIEQISEFSKRVILADANLDKVL

SAYNKHRDKPIREQAENIIHLFTLTNLGAPAAFKYFDTTIDRKRYTSTKEVLDATLIHQSITGLYETRIDLSQLGG

D

Exemplary SpEQR Cas9

(SEQ ID NO: 96)

DKKYSIGLAIGTNSVGWAVITDEYKVPSKKFKVLGNTDRHSIKKNLIGALLFDSGETAEATRLKRTARRRYTRRKN

RICYLQEIFSNEMAKVDDSFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAILSARLSKSRRLENLIAQL

PGEKKNGLFGNLIALSLGLTPNFKSNFDLAEDAKLQLSKDTYDDDLDNLLAQIGDQYADLFLAAKNLSDAILLSDI

-continued

LRVNTEITKAPLSASMIKRYDEHHQDLTLLKALVRQQLPEKYKEIFFDQSKNGYAGYIDGGASQEEFYKFIKPILE

KMDGTEELLVKLNREDLLRKQRTFDNGSIPHQIHLGELHAILRRQEDFYPFLKDNREKIEKILTFRIPYYVGPLAR

GNSRFAWMTRKSEETITPWNFEEVVDKGASAQSFIERMTNFDKNLPNEKVLPKHSLLYEYFTVYNELTKVKYVTEG

MRKPAFLSGEQKKAIVDLLFKTNRKVTVKQLKEDYFKKIECFDSVETSGVEDRFNASLGTYHDLLKIIKDKDFLDN

EENEDILEDIVLTLTLFEDREMIEERLKTYAHLFDDKVMKQLKRRRYTGWGRLSRKLINGIRDKQSGKTILDFLKS

DGFANRNFMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQELDINRLSDYD

VDHIVPQSFLKDDSIDNKVLTRSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKKDWDPKKYGGFESPTVAY

SVLVVAKVEKGKSKKLKSVKELLGITIIVIERSSFEKNPIDFLEAKGYKEVKKDLIIKLPKYSLFELENGRKRMLA

SAGELQKGNELALPSKYVNFLYLASHYEKLKGSPEDNEQKQLFVEQHKYLDEIIEQISEFSKRVILADANLDKVL

SAYNKHRDKPIREQAENIIHLFTLTNLGAPAAFKYFDTTIDRKQYRSTKEVLDATLIHQSITGLYETRIDLSQLGG

D

Residues E1134, Q1334, and R1336 above, which can be mutated from D1134,
R1334, and T1336 to yield a SpEQR Cas9, are underlined and in bold.

Exemplary SpVQR Cas9

(SEQ ID NO: 97)

DKKYSIGLAIGTNSVGWAVITDEYKVPSKKFKVLGNTDRHSIKKNLIGALLFDSGETAEATRLKRTARRRYTRRKN

RICYLQEIFSNEMAKVDDSFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAILSARLSKSRRLENLIAQL

PGEKKNGLFGNLIALSLGLTPNFKSNFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSKNGYAGYIDGGASQEEFYKFIKPILE

KMDGTEELLVKLNREDLLRKQRTFDNGSIPHQIHLGELHAILRRQEDFYPFLKDNREKEIKILTFRIPYYVGPLAR

GNSRFAWMTRKSEETITPWNFEEVVDKGASAQSFIERMTNFDKNLPNEKVLPKHSLLYEYFTVYNELTKVKYVTEG

MRKPAFLSGEQKKAIVDLLFKTNRKVTVKQLKEDYFKKIECFDSVETSGVEDRFNASLGTYHDLLKIIKDKDFLDN

EENEDILEDIVLTLTLFEDREMIEERLKTYAHLFDDKVMKQLKRRRYTGWGRLSRKLINGIRDKQSGKTILDFLKS

DGFANRNFMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQELDINRLSDYD

VDHIVPQSFLKDDSIDNKVLTRSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKKDWDPKKYGGFVSPTVAY

SVLVVAKVEKGKSKKLKSVKELLGITWIERSSFEKNPIDFLEAKGYKEVKKDLIIKLPKYSLFELENGRKRMLASA

GELQKGNELALPSKYVNFLYLASHYEKLKGSPEDNEQKQLFVEQHKYLDEIIEQISEFSKRVILADANLDKVLSA

YNKHRDKPIREQAENIIHLFTLTNLGAPAAFKYFDTTIDRKQYRSTKEVLDATLIHQSITGLYETRIDLSQLGGD

Residues V1134, Q1334, and R1336 above, which can be mutated from D1134,
R1334, and T1336 to yield a SpVQR Cas9, are underlined and in bold.

Exemplary SpVRER Cas9

(SEQ ID NO: 98)

DKKYSIGLAIGTNSVGWAVITDEYKVPSKKFKVLGNTDRHSIKKNLIGALLFDSGETAEATRLKRTARRRYTRRKN

RICYLQEIFSNEMAKVDDSFFHRLEESFLVEEDKKHERHPIFGNIVDEVAYHEKYPTIYHLRKKLVDSTDKADLRL

-continued

```
IYLALAHMIKFRGHFLIEGDLNPDNSDVDKLFIQLVQTYNQLFEENPINASGVDAKAILSARLSKSRRLENLIAQL

PGEKKNGLFGNLIALSLGLTPNFKSNFDLAEDAKLQLSKDTYDDDLDNLLAQIGDQYADLFLAAKNLSDAILLSDI

LRVNTEITKAPLSASMIKRYDEHHQDLTLLKALVRQQLPEKYKEIFFDQSKNGYAGYIDGGASQEEFYKFIKPILE

KMDGTEELLVKLNREDLLRKQRTFDNGSIPHQIHLGELHAILRRQEDFYPFLKDNREKIEKILTFRIPYYVGPLAR

GNSRFAWMTRKSEETITPWNFEEVVDKGASAQSFIERMTNFDKNLPNEKVLPKHSLLYEYFTVYNELTKVKYVTEG

MRKPAFLSGEQKKAIVDLLFKTNRKVTVKQLKEDYFKKIECFDSVETSGVEDRFNASLGTYHDLLKIIKDKDFLDN

EENEDILEDIVLTLTLFEDREMIEERLKTYAHLFDDKVMKQLKRRRYTGWGRLSRKLINGIRDKQSGKTILDFLKS

DGFANRNFMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYLYYLQNGRDMYVDQELDINRLSDYD

VDHIVPQSFLKDDSIDNKVLTRSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKKDWDPKKYGGFVSPTVAY

SVLVVAKVEKGKSKKLKSVKELLGITWIERSSFEKNPIDFLEAKGYKEVKKDLIIKLPKYSLFELENGRKRMLASA

RELQKGNELALPSKYVNFLYLASHYEKLKGSPEDNEQKQLFVEQHKHYLDEIIEQISEFSKRVILADANLDKVLSA

YNKHRDKPIREQAENIIHLFTLTNLGAPAAFKYFDTTIDRKEYRSTKEVLDATLIHQSITGLYETRIDLSQLGGD.
```

Residues V1134, R1217, Q1334, and R1336 above, which can be mutated from
D1134, G1217, R1334, and T1336 to yield a SpVRER Cas9, are underlined and in
bold.

In particular embodiments, a fusion protein of the invention comprises a dCas9 domain that binds a canonical PAM sequence and an nCas9 domain that binds a non-canonical PAM sequence (e.g., a non-canonical PAM identified in Table 1). In another embodiment, a fusion protein of the invention comprises an nCas9 domain that binds a canonical PAM sequence and an dCas9 domain that binds a non-canonical PAM sequence (e.g., a non-canonical PAM identified in Table 1).

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. In one particular embodiment, a fusion protein of the invention comprises one high fidelity Cas9 domain and a Cas9 domain that is not a high fidelity Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

```
High Fidelity Cas9 domain mutations relative to
Cas9 are shown in bold and underlines
                                    (SEQ ID NO: 99)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK
```

```
-continued
QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYEKKIECFDSVETSGVEDRFNASLGTYHDLLKII

KDKDFLDNEENEDILEDIVLTLTLFEDREMIEERLKTYAHLFDDKVMKQL

KRRRYTGWGALSRKLINGIRDKQSGKTILDFLKSDGEANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKEDNLT

KAERGGLSELDKAGFIKRQLVETRAITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD
```

Nucleic Acid Programmable DNA Binding Proteins

Some aspects of the disclosure provide fusion proteins comprising domains that act as nucleic acid programmable DNA binding proteins, which may be used to guide a protein, such as a base editor, to a specific nucleic acid (e.g., DNA or RNA) sequence. Nucleic acid programmable DNA binding proteins include, without limitation, Cas9 (e.g., dCas9 and nCas9), CasX, CasY, Cpf1, C2cl, and C2c3. One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., *Cell*, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A. It should be appreciated that Cpf1 from other bacterial species may also be used in accordance with the present disclosure.

```
Wild type Francisella novicida Cpf1 (D917, E1006, and D1255 are bolded and underlined)
                                                         (SEQ ID NO: 100)
MSIYQEFVNKYSLSKTLRFELIPQGKTLENIKARGLILDDEKRAKDYKKAKQIIDKYHQFFIEEILSSVCISEDLLQNYSDVYFKL KKSDDDNLQKDFKSAKDTIKKQISEYIKDSEKFKNLFNQNLIDAKKGQESDLILWLKQSKDNGIELFKANSDITDIDEALEIIKSF KGWTTYFKGFHENRKNVYSSNDIPTSITYRIVDDNLPKFLENKAKYESLKDKAPEAINYEQIKKDLAEELTFDIDYKTSEVNQRVF SLDEVFEIANFNNYLNQSGITKFNTIIGGKFVNGENTKRKGINEYINLYSQQINDKTLKKYKMSVLFKQILSDTESKSFVIDKLED DSDVVTTMQSFYEQIAAFKTVEEKSIKETLSLLFDDLKAQKLDLSKIYFKNDKSLTDLSQQVFDDYSVIGTAVLEYITQQIAPKNL DNPSKKEQELIAKKTEKAKYLSLETIKLALEEFNKHRDIDKQCRFEEILANFAAIPMIFDEIAQNKDNLAQISIKYQNQGKKDLLQ ASAEDDVKAIKDLLDQTNNLLHKLKIFHISQSEDKANILDKDEHFYLVFEECYFELANIVPLYNKIRNYITQKPYSDEKFKLNFEN STLANGWDKNKEPDNTAILFIKDDKYYLGVMNKKNNKIFDDKAIKENKGEGYKKIVYKLLPGANKMLPKVFFSAKSIKFYNPSEDI
```

-continued

LRIRNHSTHTKNGSPQKGYEKFEFNIEDCRKFIDFYKQSISKHPEWKDFGFRFSDTQRYNSIDEFYREVENQGYKLTFENISESYI

DSVVNQGKLYLFQIYNKDFSAYSKGRPNLHTLYWKALFDERNLQDVVYKLNGEAELFYRKQSIPKKITHPAKEAIANKNKDNPKKE

SVFEYDLIKDKRFTEDKFFFHCPITINFKSSGANKFNDEINLLLKEKANDVHILSIDRGERHLAYYTLVDGKGNIIKQDTFNIIGN

DRMKTNYHDKLAAIEKDRDSARKDWKKINNIKEMKEGYLSQVVHEIAKLVIEYNAIVVFEDLNFGFKRGRFKVEKQVYQKLEKMLI

EKLNYLVFKDNEFDKTGGVLRAYQLTAPFETFKKMGKQTGIIYYVPAGFTSKICPVTGFVNQLYPKYESVSKSQEFFSKFDKICYN

LDKGYFEFSFDYKNFGDKAAKGKWTIASFGSRLINFRNSDKNHNWDTREVYPTKELEKLLKDYSIEYGHGECIKAAICGESDKKFF

AKLTSVLNTILQMRNSKTGTELDYLISPVADVNGNFFDSRQAPKNMPQDADANGAYHIGLKGLMLLGRIKNNQEGKKLNLVIKNEE

YFEFVQNRNN

*Francisella novicida* Cpf1 D917A (A917, E1006, and D1255 are bolded and underlined)
(SEQ ID NO: 101)

MSIYQEFVNKYSLSKTLRFELIPQGKTLENIKARGLILDDEKRAKDYKKAKQIIDKYHQFFIEEILSSVCISEDLLQNYSDVYFKL

KKSDDDNLQKDFKSAKDTIKKQISEYIKDSEKFKNLFNQNLIDAKKGQESDLILWLKQSKDNGIELFKANSDITDIDEALEIIKSF

KGWTTYFKGFHENRKNVYSSNDIPTSITYRIVDDNLPKFLENKAKYESLKDKAPEAINYEQIKKDLAEELTFDIDYKTSEVNQRVF

SLDEVFEIANFNNYLNQSGITKFNTIIGGKFVNGENTKRKGINEYINLYSQQINDKTLKKYKMSVLFKQILSDTESKSFVIDKLED

DSDVVTTMQSFYEQIAAFKTVEEKSIKETLSLLFDDLKAQKLDLSKIYFKNDKSLTDLSQQVFDDYSVIGTAVLEYITQQIAPKNL

DNPSKKEQELIAKKTEKAKYLSLETIKLALEEFNKHRDIDKQCRFEEILANFAAIPMIFDEIAQNKDNLAQISIKYQNQGKKDLLQ

ASAEDDVKAIKDLLDQTNNLLHKLKIFHISQSEDKANILDKDEHFYLVFEECYFELANIVPLYNKIRNYITQKPYSDEKFKLNFEN

STLANGWDKNKEPDNTAILFIKDDKYYLGVMNKKNNKIFDDKAIKENKGEGYKKIVYKLLPGANKMLPKVFFSAKSIKFYNPSEDI

LRIRNHSTHTKNGSPQKGYEKFEFNIEDCRKFIDFYKQSISKHPEWKDFGFRFSDTQRYNSIDEFYREVENQGYKLTFENISESYI

DSVVNQGKLYLFQIYNKDFSAYSKGRPNLHTLYWKALFDERNLQDVVYKLNGEAELFYRKQSIPKKITHPAKEAIANKNKDNPKKE

SVFEYDLIKDKRFTEDKFFFHCPITINFKSSGANKFNDEINLLLKEKANDVHILSIARGERHLAYYTLVDGKGNIIKQDTFNIIGN

DRMKTNYHDKLAAIEKDRDSARKDWKKINNIKEMKEGYLSQVVHEIAKLVIEYNAIVVFEDLNFGFKRGRFKVEKQVYQKLEKMLI

EKLNYLVFKDNEFDKTGGVLRAYQLTAPFETFKKMGKQTGIIYYVPAGFTSKICPVTGFVNQLYPKYESVSKSQEFFSKFDKICYN

LDKGYFEFSFDYKNFGDKAAKGKWTIASFGSRLINFRNSDKNHNWDTREVYPTKELEKLLKDYSIEYGHGECIKAAICGESDKKFF

AKLTSVLNTILQMRNSKTGTELDYLISPVADVNGNFFDSRQAPKNMPQDADANGAYHIGLKGLMLLGRIKNNQEGKKLNLVIKNEE

YFEFVQNRNN

*Francisella novicida* Cpf1 E1006A (D917, A1006, and D1255 are bolded and underlined)
(SEQ ID NO: 102)

MSIYQEFVNKYSLSKTLRFELIPQGKTLENIKARGLILDDEKRAKDYKKAKQIIDKYHQFFIEEILSSVCISEDLLQNYSDVYFKL

KKSDDDNLQKDFKSAKDTIKKQISEYIKDSEKFKNLFNQNLIDAKKGQESDLILWLKQSKDNGIELFKANSDITDIDEALEIIKSF

KGWTTYFKGFHENRKNVYSSNDIPTSIIYRIVDDNLPKFLENKAKYESLKDKAPEAINYEQIKKDLAEELTFDIDYKTSEVNQRVF

SLDEVFEIANFNNYLNQSGITKFNTIIGGKFVNGENTKRKGINEYINLYSQQINDKTLKKYKMSVLFKQILSDTESKSFVIDKLED

DSDVVTTMQSFYEQIAAFKTVEEKSIKETLSLLFDDLKAQKLDLSKIYFKNDKSLTDLSQQVFDDYSVIGTAVLEYITQQIAPKNL

DNPSKKEQELIAKKTEKAKYLSLETIKLALEEFNKHRDIDKQCRFEEILANFAAIPMIFDEIAQNKDNLAQISIKYQNQGKKDLLQ

ASAEDDVKAIKDLLDQTNNLLHKLKIFHISQSEDKANILDKDEHFYLVFEECYFELANIVPLYNKIRNYITQKPYSDEKFKLNFEN

STLANGWDKNKEPDNTAILFIKDDKYYLGVMNKKNNKIFDDKAIKENKGEGYKKIVYKLLPGANKMLPKVFFSAKSIKFYNPSEDI

LRIRNHSTHTKNGSPQKGYEKFEFNIEDCRKFIDFYKQSISKHPEWKDFGFRFSDTQRYNSIDEFYREVENQGYKLTFENISESYI

DSVVNQGKLYLFQIYNKDFSAYSKGRPNLHTLYWKALFDERNLQDVVYKLNGEAELFYRKQSIPKKITHPAKEAIANKNKDNPKKE

SVFEYDLIKDKRFTEDKFFFHCPITINFKSSGANKFNDEINLLLKEKANDVHILSIDRGERHLAYYTLVDGKGNIIKQDTFNIIGN

DRMKTNYHDKLAAIEKDRDSARKDWKKINNIKEMKEGYLSQVVHEIAKLVIEYNAIVVFADLNFGFKRGRFKVEKQVYQKLEKMLI

EKLNYLVFKDNEFDKTGGVLRAYQLTAPFETFKKMGKQTGIIYYVPAGFTSKICPVTGFVNQLYPKYESVSKSQEFFSKFDKICYN

-continued

LDKGYFEFSFDYKNFGDKAAKGKWTIASFGSRLINFRNSDKNHNWDTREVYPTKELEKLLKDYSIEYGHGECIKAAICGESDKKFF

AKLTSVLNTILQMRNSKTGTELDYLISPVADVNGNFFDSRQAPKNMPQDADANGAYHIGLKGLMLLGRIKNNQEGKKLNLVIKNEE

YFEFVQNRNN

*Francisella novicida* Cpf1 D1255A (D917, E1006, and A1255 are bolded and underlined)

(SEQ ID NO: 103)

MSIYQEFVNKYSLSKTLRFELIPQGKTLENIKARGLILDDEKRAKDYKKAKQIIDKYHQFFIEEILSSVCISEDLLQNYSDVYFKL

KKSDDDNLQKDFKSAKDTIKKQISEYIKDSEKFKNLFNQNLIDAKKGQESDLILWLKQSKDNGIELFKANSDITDIDEALEIIKSF

KGWTTYFKGFHENRKNVYSSNDIPTSIIYRIVDDNLPKFLENKAKYESLKDKAPEAINYEQIKKDLAEELTFDIDYKTSEVNQRVF

SLDEVFEIANFNNYLNQSGITKFNTIIGGKFVNGENTKRKGINEYINLYSQQINDKTLKKYKMSVLFKQILSDTESKSFVIDKLED

DSDVVTTMQSFYEQIAAFKTVEEKSIKETLSLLFDDLKAQKLDLSKIYFKNDKSLTDLSQQVFDDYSVIGTAVLEYITQQIAPKNL

DNPSKKEQELIAKKTEKAKYLSLETIKLALEEFNKHRDIDKQCRFEEILANFAAIPMIFDEIAQNKDNLAQISIKYQNQGKKDLLQ

ASAEDDVKAIKDLLDQTNNLLHKLKIFHISQSEDKANILDKDEHFYLVFEECYFELANIVPLYNKIRNYITQKPYSDEKFKLNFEN

STLANGWDKNKEPDNTAILFIKDDKYYLGVMNKKNNKIFDDKAIKENKGEGYKKIVYKLLPGANKMLPKVFFSAKSIKFYNPSEDI

LRIRNHSTHTKNGSPQKGYEKFEFNIEDCRKFIDFYKQSISKHPEWKDFGFRFSDTQRYNSIDEFYREVENQGYKLTFENISESYI

DSVVNQGKLYLFQIYNKDFSAYSKGRPNLHTLYWKALFDERNLQDVVYKLNGEAELFYRKQSIPKKITHPAKEAIANKNKDNPKKE

SVFEYDLIKDKRFTEDKFFFHCPITINFKSSGANKFNDEINLLLKEKANDVHILSIDRGERHLAYYTLVDGKGNIIKQDTFNIIGN

DRMKTNYHDKLAAIEKDRDSARKDWKKINNIKEMKEGYLSQVVHEIAKLVIEYNAIVVEDLNFGFKRGRFKVEKQVYQKLEKMLI

EKLNYLVFKDNEFDKTGGVLRAYQLTAPFETFKKMGKQTGIIYYVPAGFTSKICPVTGFVNQLYPKYESVSKSQEFFSKFDKICYN

LDKGYFEFSFDYKNFGDKAAKGKWTIASFGSRLINFRNSDKNHNWDTREVYPTKELEKLLKDYSIEYGHGECIKAAICGESDKKFF

AKLTSVLNTILQMRNSKTGTELDYLISPVADVNGNFFDSRQAPKNMPQDAAANGAYHIGLKGLMLLGRIKNNQEGKKLNLVIKNEE

YFEFVQNRNN

*Francisella novicida* Cpf1 D917A/E1006A (A917, A1006, and D1255 are bolded and underlined)

(SEQ ID NO: 104)

MSIYQEFVNKYSLSKTLRFELIPQGKTLENIKARGLILDDEKRAKDYKKAKQIIDKYHQFFIEEILSSVCISEDLLQNYSDVYFKL

KKSDDDNLQKDFKSAKDTIKKQISEYIKDSEKFKNLFNQNLIDAKKGQESDLILWLKQSKDNGIELFKANSDITDIDEALEIIKSF

KGWTTYFKGFHENRKNVYSSNDIPTSIIYRIVDDNLPKFLENKAKYESLKDKAPEAINYEQIKKDLAEELTFDIDYKTSEVNQRVF

SLDEVFEIANFNNYLNQSGITKFNTIIGGKFVNGENTKRKGINEYINLYSQQINDKTLKKYKMSVLFKQILSDTESKSFVIDKLED

DSDVVTTMQSFYEQIAAFKTVEEKSIKETLSLLFDDLKAQKLDLSKIYFKNDKSLTDLSQQVFDDYSVIGTAVLEYITQQIAPKNL

DNPSKKEQELIAKKTEKAKYLSLETIKLALEEFNKHRDIDKQCRFEEILANFAAIPMIFDEIAQNKDNLAQISIKYQNQGKKDLLQ

ASAEDDVKAIKDLLDQTNNLLHKLKIFHISQSEDKANILDKDEHFYLVFEECYFELANIVPLYNKIRNYITQKPYSDEKFKLNFEN

STLANGWDKNKEPDNTAILFIKDDKYYLGVMNKKNNKIFDDKAIKENKGEGYKKIVYKLLPGANKMLPKVFFSAKSIKFYNPSEDI

LRIRNHSTHTKNGSPQKGYEKFEFNIEDCRKFIDFYKQSISKHPEWKDFGFRFSDTQRYNSIDEFYREVENQGYKLTFENISESYI

DSVVNQGKLYLFQIYNKDFSAYSKGRPNLHTLYWKALFDERNLQDVVYKLNGEAELFYRKQSIPKKITHPAKEAIANKNKDNPKKE

SVFEYDLIKDKRFTEDKFFFHCPITINFKSSGANKFNDEINLLLKEKANDVHILSIARGERHLAYYTLVDGKGNIIKQDTFNIIGN

DRMKTNYHDKLAAIEKDRDSARKDWKKINNIKEMKEGYLSQVVHEIAKLVIEYNAIVVADLNFGFKRGRFKVEKQVYQKLEKMLI

EKLNYLVFKDNEFDKTGGVLRAYQLTAPFETFKKMGKQTGIIYYVPAGFTSKICPVTGFVNQLYPKYESVSKSQEFFSKFDKICYN

LDKGYFEFSFDYKNFGDKAAKGKWTIASFGSRLINFRNSDKNHNWDTREVYPTKELEKLLKDYSIEYGHGECIKAAICGESDKKFF

AKLTSVLNTILQMRNSKTGTELDYLISPVADVNGNFFDSRQAPKNMPQDADANGAYHIGLKGLMLLGRIKNNQEGKKLNLVIKNEE

YFEFVQNRNN

-continued

*Francisella novicida* Cpf1 D917A/D1255A (A917, E1006, and A1255 are bolded and underlined)

(SEQ ID NO: 105)
MSIYQEFVNKYSLSKTLRFELIPQGKTLENIKARGLILDDEKRAKDYKKAKQIIDKYHQFFIEEILSSVCISEDLLQNYSDVYFKL

KKSDDDNLQKDFKSAKDTIKKQISEYIKDSEKFKNLFNQNLIDAKKGQESDLILWLKQSKDNGIELFKANSDITDIDEALEIIKSF

KGWTTYFKGFHENRKNVYSSNDIPTSIIYRIVDDNLPKFLENKAKYESLKDKAPEAINYEQIKKDLAEELTFDIDYKTSEVNQRVF

SLDEVFEIANFNNYLNQSGITKFNTIIGGKFVNGENTKRKGINEYINLYSQQINDKTLKKYKMSVLFKQILSDTESKSFVIDKLED

DSDVVTTMQSFYEQIAAFKTVEEKSIKETLSLLFDDLKAQKLDLSKIYFKNDKSLTDLSQQVFDDY1SVIGTAVLEYITQQIAPKN

LDNPSKKEQELIAKKTEKAKYLSLETIKLALEEFNKHRDIDKQCRFEEILANFAAIPMIFDEIAQNKDNLAQISIKYQNQGKKDLL

QASAEDDVKAIKDLLDQTNNLLHKLKIFHISQSEDKANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKGEGYKKIVYKLLPGANKMLPKVFFSAKSIKFYNPSED

ILRIRNHSTHTKNGSPQKGYEKFEFNIEDCRKFIDFYKQSISKHPEWKDFGFRFSDTQRYNSIDEFYREVENQGYKLTFENISESY

IDSVVNQGKLYLFQIYNKDFSAYSKGRPNLHTLYWKALFDERNLQDVVYKLNGEAELFYRKQSIPKKITHPAKEAIANKNKDNPKK

ESVFEYDLIKDKRFTEDKFFFHCPITINFKSSGANKFNDEINLLLKEKANDVHILSIARGERHLAYYTLVDGKGNIIKQDTFNIIG

NDRMKTNYHDKLAAIEKDRDSARKDWKKINNIKEMKEGYLSQVVHEIAKLVIEYNAIVVFEDLNFGFKRGRFKVEKQVYQKLEKML

IEKLNYLVFKDNEFDKTGGVLRAYQLTAPFETFKKMGKQTGIIYYVPAGFTSKICPVTGFVNQLYPKYESVSKSQEFFSKFDKICY

NLDKGYFEFSFDYKNFGDKAAKGKWTIASFGSRLINFRNSDKNHNWDTREVYPTKELEKLLKDYSIEYGHGECIKAAICGESDKKF

FAKLTSVLNTILQMRNSKTGTELDYLISPVADVNGNFFDSRQAPKNMPQDAAANGAYHIGLKGLMLLGRIKNNQEGKKLNLVIKNE

EYFEFVQNRNN

*Francisella novicida* Cpf1 E1006A/D1255A (D917, A1006, and A1255 are bolded and underlined)

(SEQ ID NO: 106)
MSIYQEFVNKYSLSKTLRFELIPQGKTLENIKARGLILDDEKRAKDYKKAKQIIDKYHQFFIEEILSSVCISEDLLQNYSDVYFKL

KKSDDDNLQKDFKSAKDTIKKQISEYIKDSEKFKNLFNQNLIDAKKGQESDLILWLKQSKDNGIELFKANSDITDIDEALEIIKSF

KGWTTYFKGFHENRKNVYSSNDIPTSIIYRIVDDNLPKFLENKAKYESLKDKAPEAINYEQIKKDLAEELTFDIDYKTSEVNQRVF

SLDEVFEIANFNNYLNQSGITKFNTIIGGKFVNGENTKRKGINEYINLYSQQINDKTLKKYKMSVLFKQILSDTESKSFVIDKLED

DSDVVTTMQSFYEQIAAFKTVEEKSIKETLSLLFDDLKAQKLDLSKIYFKNDKSLTDLSQQVFDDYSVIGTAVLEYITQQIAPKNL

DNPSKKEQELIAKKTEKAKYLSLETIKLALEEFNKHRDIDKQCRFEEILANFAAIPMIFDEIAQNKDNLAQISIKYQNQGKKDLLQ

ASAEDDVKAIKDLLDQTNNLLHKLKIFHISQSEDKANILDKDEHFYLVFEECYFELANIVPLYNKIRNYITQKPYSDEKFKLNFEN

STLANGWDKNKEPDNTAILFIKDDKYYLGVMNKKNNKIFDDKAIKENKGEGYKKIVYKLLPGANKMLPKVFFSAKSIKFYNPSEDI

LRIRNHSTHTKNGSPQKGYEKFEFNIEDCRKFIDFYKQSISKHPEWKDFGFRFSDTQRYNSIDEFYREVENQGYKLTFENISESYI

DSVVNQGKLYLFQIYNKDFSAYSKGRPNLHTLYWKALFDERNLQDVVYKLNGEAELFYRKQSIPKKITHPAKEAIANKNKDNPKKE

SVFEYDLIKDKRFTEDKFFFHCPITINFKSSGANKFNDEINLLLKEKANDVHILSIDRGERHLAYYTLVDGKGNIIKQDTFNIIGN

DRMKTNYHDKLAAIEKDRDSARKDWKKINNIKEMKEGYLSQVVHEIAKLVIEYNAIVVFADLNFGFKRGRFKVEKQVYQKLEKMLI

EKLNYLVFKDNEFDKTGGVLRAYQLTAPFETFKKMGKQTGIIYYVPAGFTSKICPVTGFVNQLYPKYESVSKSQEFFSKFDKICYN

LDKGYFEFSFDYKNFGDKAAKGKWTIASFGSRLINFRNSDKNHNWDTREVYPTKELEKLLKDYSIEYGHGECIKAAICGESDKKFF

AKLTSVLNTILQMRNSKTGTELDYLISPVADVNGNFFDSRQAPKNMPQDAAANGAYHIGLKGLMLLGRIKNNQEGKKLNLVIKNEE

YFEFVQNRNN

*Francisella novicida* Cpf1 D917A/E1006A/D1255A (A917, A1006, and A1255 are bolded and underlined)

(SEQ ID NO: 107)
MSIYQEFVNKYSLSKTLRFELIPQGKTLENIKARGLILDDEKRAKDYKKAKQIIDKYHQFFIEEILSSVCISEDLLQNYSDVYFKL

KKSDDDNLQKDFKSAKDTIKKQISEYIKDSEKFKNLFNQNLIDAKKGQESDLILWLKQSKDNGIELFKANSDITDIDEALEIIKSF

KGWTTYFKGFHENRKNVYSSNDIPTSIYRIVDDNLPKFLENKAKYESLKDKAPEAINYEQIKKDLAEELTEDIDYKTSEVNQRVF

SLDEVFEIANFNNYLNQSGITKENTIIGGKEVNGENTKRKGINEYINLYSQQINDKTLKKYKMSVLFKQILSDTESKSFVIDKLED

-continued

```
DSDVVTTMQSFYEQIAAFKTVEEKSIKETLSLLFDDLKAQKLDLSKIYFKNDKSLTDLSQQVFDDYSVIGTAVLEYITQQIAPKNL

DNPSKKEQELIAKKTEKAKYLSLETIKLALEEFNKHRDIDKQCRFEEILANFAAIPMIFDEIAQNKDNLAQISIKYQNQGKKDLLQ

ASAEDDVKAIKDLLDQTNNLLHKLKIFHISQSEDKANILDKDEHFYLVFEECYFELANIVPLYNKIRNYITQKPYSDEKFKLNFEN

STLANGWDKNKEPDNTAILFIKDDKYYLGVMNKKNNKIFDDKAIKENKGEGYKKIVYKLLPGANKMLPKVFFSAKSIKEYNPSEDI

LRIRNHSTHTKNGSPQKGYEKFEENIEDCRKFIDEYKQSISKHPEWKDFGFRFSDTQRYNSIDEFYREVENQGYKLTFENISESYI

DSVVNQGKLYLFQIYNKDFSAYSKGRPNLHTLYWKALFDERNLQDVVYKLNGEAELFYRKQSIPKKITHPAKEAIANKNKDNPKKE

SVFEYDLIKDKRFTEDKEFFHCPITINFKSSGANKFNDEINLLLKEKANDVHILSIARGERHLAYYTLVDGKGNIIKQDTFNIIGN

DRMKTNYHDKLAAIEKDRDSARKDWKKINNIKEMKEGYLSQVVHEIAKLVIEYNAIVVFADLNEGFKRGREKVEKQVYQKLEKMLI

EKLNYLVEKDNEFDKTGGVLRAYQLTAPFETFKKMGKQTGIIYYVPAGFTSKICPVTGEVNQLYPKYESVSKSQEFFSKFDKICYN

LDKGYFEFSFDYKNFGDKAAKGKWTIASFSGSRLINFRNSDKNHNWDTREVYPTKELEKLLKDYSIEYGHGECIKAAICGESDKKFF

AKLTSVLNTILQMRNSKTGTELDYLISPVADVNGNFEDSRQAPKNMPQDAAANGAYHIGLKGLMLLGRIKNNQEGKKLNLVIKNEE

YFEFVQNRNN
```

In particular embodiments, a fusion protein of the invention comprises an nCas9 domain that binds a canonical PAM sequence and a dCas9 domain derived from *Prevotella* and *Francisella* 1 (Cpf1) that has a different PAM specificity. In another embodiment, a fusion protein of the invention comprises an dCas9 domain that binds a canonical PAM sequence and an nCas9 domain derived from *Prevotella* and *Francisella* 1 (Cpf1) that has a different PAM specificity.

In some embodiments, one of the Cas9 domains present in the fusion protein may be replaced with a guide nucleotide sequence-programmable DNA-binding protein domain that has no requirements for a PAM sequence.

In some embodiments, the nucleic acid programmable DNA binding protein (napDNAbp) is a single effector of a microbial CRISPR-Cas system. Single effectors of microbial CRISPR-Cas systems include, without limitation, Cas9, Cas12a/Cpf1, Cas12b/C2c1, Cas12c/C2c3, Cas12d/CasY, Cas12e/CasX, Cas12g, Cas12h, and Cas12i. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (C2c1 and C2c3) have been described by Shmakov et al., "Discovery and Functional Characterization of Diverse Class 2 CRISPR Cas Systems", *Mol. Cell*, 2015 Nov. 5; 60 (3): 385-397, the entire contents of which is hereby incorporated by reference. Effectors of two of the systems, C2c1 and C2c3, contain RuvC-like endonuclease domains related to Cpf1. A third system, contains an effector with two predicated HEPN RNase domains. Production of mature CRISPR RNA is tracrRNA-independent, unlike production of CRISPR RNA by C2c1. C2c1 depends on both CRISPR RNA and tracrRNA for DNA cleavage.

The crystal structure of *Alicyclobaccillus acidoterrastris* C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell*, 2017 Jan. 19; 65 (2): 310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell*, 2016 Dec. 15; 167 (7): 1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a C2c1, or a C2c3 protein. In some embodiments, the napDNAbp is a C2c1 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring C2c1 or C2c3 protein. In some embodiments, the napDNAbp is a naturally-occurring C2c1 or C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that C2c1 or C2c3 from other bacterial species may also be used in accordance with the present disclosure.

```
C2c1 (uniprot.org/uniprot/T0D7A2#2)
sp|T0D7A2|C2C1_ALIAG CRISPR-associated
endo-nuclease C2c1 OS = Alicyclobacillus
acido-terrestris (strain ATCC 49025/
DSM 3922/CIP 106132/NCIMB 13137/GD3B)
GN = c2c1 PE = 1 SV = 1
                              (SEQ ID NO: 108)
MAVKSIKVKLRLDDMPEIRAGLWKLHKEVNA

GVRYYTEWLSLLRQENLYRRSPNGDGEQECD

KTAEECKAELLERLRARQVENGHRGPAGSDD

ELLQLARQLYELLVPQAIGAKGDAQQIARKF

LSPLADKDAVGGLGIAKAGNKPRWVRMREAG
```

```
EPGWEEEKEKAETRKSADRTADVLRALADFG
LKPLMRVYTDSEMSSVEWKPLRKGQAVRTWD
RDMFQQAIERMMSWESWNQRVGQEYAKLVEQ
KNRFEQKNFVGQEHLVHLVNQLQQDMKEASP
GLESKEQTAHYVTGRALRGSDKVFEKWGKLA
PDAPFDLYDAEIKNVQRRNTRRFGSHDLFAK
LAEPEYQALWREDASFLTRYAVYNSILRKLN
HAKMFATFTLPDATAHPIWTRFDKLGGNLHQ
YTFLFNEFGERRHAIRFHKLLKVENGVAREV
DDVTVPISMSEQLDNLLPRDPNEPIALYFRD
YGAEQHFTGEFGGAKIQCRRDQLAHMHRRRG
ARDVYLNVSVRVQSQSEARGERRPPYAAVFR
LVGDNHRAFVHFDKLSDYLAEHPDDGKLGSE
GLLSGLRVMSVDLGLRTSASISVFRVARKDE
LKPNSKGRVPFFFPIKGNDNLVAVHERSQLL
KLPGETESKDLRAIREERQRTLRQLRTQLAY
LRLLVRCGSEDVGRRERSWAKLIEQPVDAAN
HMTPDWREAFENELQKLKSLHGICSDKEWMD
AVYESVRRVWRHMGKQVRDWRKDVRSGERPK
IRGYAKDVVGGNSIEQIEYLERQYKFLKSWS
FFGKVSGQVIRAEKGSRFAITLREHIDHAKE
DRLKKLADRIIMEALGYVYALDERGKGKWVA
KYPPCQLILLEELSEYQFNNDRPPSENNQLM
QWSHRGVFQELINQAQVHDLLVGTMYAAFSS
RFDARTGAPGIRCRRVPARCTQEHNPEPFPW
WLNKFVVEHTLDACPLRADDLIPTGEGEIFV
SPFSAEEGDFHQIHADLNAAQNLQQRLWSDF
DISQIRLRCDWGEVDGELVLIPRLTGKRTAD
SYSNKVFYTNTGVTYYERERGKKRRKVFAQE
KLSEEEAELLVEADEAREKSVVLMRDPSGII
NRGNWTRQKEFWSMVNQRIEGYLVKQIRSRV
PLQDSACENTGDI
BhCas12b (Bacillus hisashii) NCBI
Reference Sequence: WP_095142515
                                 (SEQ ID NO: 109)
MAPKKKRKVGIHGVPAAATRSFILKIEPNEE
VKKGLWKTHEVLNHGIAYYMNILKLIRQEAI
YEHHEQDPKNPKKVSKAEIQAELWDFVLKMQ
KCNSFTHEVDKDEVFNILRELYEELVPSSVE
KKGEANQLSNKFLYPLVDPNSQSGKGTASSG
RKPRWYNLKIAGDPSWEEEKKKWEEDKKKDP
LAKILGKLAEYGLIPLFIPYTDSNEPIVKEI
KWMEKSRNQSVRRLDKDMFIQALERFLSWES
WNLKVKEEYEKVEKEYKTLEERIKEDIQALK
ALEQYEKERQEQLLRDTLNTNEYRLSKRGLR
GWREIIQKWLKMDENEPSEKYLEVFKDYQRK
HPREAGDYSVYEFLSKKENHFIWRNHPEYPY
LYATFCEIDKKKKDAKQQATFTLADPINHPL
WVRFEERSGSNLNKYRILTEQLHTEKLKKKL
TVQLDRLIYPTESGGWEEKGKVDIVLLPSRQ
FYNQIFLDIEEKGKHAFTYKDESIKFPLKGT
LGGARVQFDRDHLRRYPHKVESGNVGRIYFN
MTVNIEPTESPVSKSLKIHRDDFPKVVNFKP
KELTEWIKDSKGKKLKSGIESLEIGLRVMSI
DLGQRQAAAASIFEVVDQKPDIEGKLFFPIK
GTELYAVHRASFNIKLPGETLVKSREVLRKA
REDNLKLMNQKLNFLRNVLHFQQFEDITERE
KRVTKWISRQENSDVPLVYQDELIQIRELMY
KPYKDWVAFLKQLHKRLEVEIGKEVKHWRKS
LSDGRKGLYGISLKNIDEIDRTRKFLLRWSL
RPTEPGEVRRLEPGQRFAIDQLNHLNALKED
RLKKMANTIIMHALGYCYDVRKKKWQAKNPA
CQIILFEDLSNYNPYEERSRFENSKLMKWSR
REIPRQVALQGEIYGLQVGEVGAQFSSRFHA
KTGSPGIRCSVVTKEKLQDNRFFKNLQREGR
LTLDKIAVLKEGDLYPDKGGEKFISLSKDRK
CVTTHADINAAQNLQKRFWTRTHGFYKVYCK
AYQVDGQTVYIPESKDQKQKIIEEFGEGYFI
LKDGVYEWVNAGKLKIKKGSSKQSSSELVDS
DILKDSFDLASELKGEKLMLYRDPSGNVFPS
DKWMAAGVFFGKLERILISKLTNQYSISTIE
DDSSKQSMKRPAATKKAGQAKKKK
```

In some embodiments, the Cas12b is BvCas12B, which is a variant of BhCas12b and comprises the following changes relative to BhCas12B: S893R, K846R, and E837G.

```
BvCas12b (Bacillus sp. V3-13) NCBI
Reference Sequence: WP_101661451.1
                                 (SEQ ID NO: 110)
MAIRSIKLKMKTNSGTDSIYLRKALWRTHQL
INEGIAYYMNLLTLYRQEAIGDKTKEAYQAE
LINIIRNQQRNNGSSEEHGSDQEILALLRQL
YELIIPSSIGESGDANQLGNKFLYPLVDPNS
QSGKGTSNAGRKPRWKRLKEEGNPDWELEKK
KDEERKAKDPTVKIFDNLNKYGLLPLFPLFT
```

-continued

```
NIQKDIEWLPLGKRQSVRKWDKDMFIQAIER

LLSWESWNRRVADEYKQLKEKTESYYKEHLT

GGEEWIEKIRKFEKERNMELEKNAFAPNDGY

FITSRQIRGWDRVYEKWSKLPESASPEELWK

VVAEQQNKMSEGFGDPKVFSFLANRENRDIW

RGHSERIYHIAAYNGLQKKLSRTKEQATFTL

PDAIEHPLWIRYESPGGTNLNLFKLEEKQKK

NYYVTLSKIIWPSEEKWIEKENIEIPLAPSI

QFNRQIKLKQHVKGKQEISFSDYSSRISLDG

VLGGSRIQFNRKYIKNHKELLGEGDIGPVFF

NLVVDVAPLQETRNGRLQSPIGKALKVISSD

FSKVIDYKPKELMDWMNTGSASNSFGVASLL

EGMRVMSIDMGQRTSASVSIFEVVKELPKDQ

EQKLFYSINDTELFAIHKRSFLLNLPGEVVT

KNNKQQRQERRKKRQFVRSQIRMLANVLRLE

TKKTPDERKKAIHKLMEIVQSYDSWTASQKE

VWEKELNLLTNMAAFNDEIWKESLVELHHRI

EPYVGQIVSKWRKGLSEGRKNLAGISMWNID

ELEDTRRLLISWSKRSRTPGEANRIETDEPF

GSSLLQHIQNVKDDRLKQMANLIIMTALGFK

YDKEEKDRYKRWKETYPACQIILFENLNRYL

FNLDRSRRENSRLMKWAHRSIPRTVSMQGEM

FGLQVGDVRSEYSSRFHAKTGAPGIRCHALT

EEDLKAGSNTLKRLIEDGFINESELAYLKKG

DIIPSQGGELFVTLSKRYKKDSDNNELTVIH

ADINAAQNLQKRFWQQNSEVYRVPCQLARMG

EDKLYIPKSQTETIKKYFGKGSFVKNNTEQE

VYKWEKSEKMKIKTDTTFDLQDLDGFEDISK

TIELAQEQQKKYLTMFRDPSGYFFNNETWRP

QKEYWSIVNNIIKSCLKKKILSNKVEL
```

The Cas9 nuclease has two functional endonuclease domains: RuvC and HNH. Cas9 undergoes a conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some cases, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)] (e.g., $(b+c)/(a+b+c)$, where "a" is the band intensity of DNA substrate and "b" and "c" are the cleavage products).

In some cases, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2}) \times 100$, where "a" is the band intensity of DNA substrate and "b" and "c" are the cleavage products (Ran et. al., 2013 Sep. 12; 154 (6): 1380-9; and Ran et al., Nat Protoc. 2013 November; 8 (11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most cases, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag.

In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some cases, Cas9 is a variant Cas9 protein. A variant Cas9 polypeptide has an amino acid sequence that is different by one amino acid (e.g., has a deletion, insertion, substitution, fusion) when compared to the amino acid sequence of a wild type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some cases, the variant Cas9 protein has no substantial nuclease activity. When a subject Cas9 protein is a variant Cas9 protein that has no substantial nuclease activity, it can be referred to as "dCas9."

In some cases, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some cases, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337 (6096): 816-21).

In some cases, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some cases, a variant Cas9 protein has a reduced ability to cleave both the complementary and the non-complementary strands of a double stranded target DNA. As a non-limiting example, in some cases, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors H840A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors H840A, D10A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some cases, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins more similar to types I and III than from type II systems. Functional Cpf1 doesn't need the trans-activating CRISPR RNA (tracrRNA), therefore, only CRISPR (crRNA) is required. This benefits genome editing because Cpf1 is not only smaller than Cas9, but also it has a smaller sgRNA molecule (proximately half as many nucleotides as Cas9). The Cpf1-crRNA complex cleaves target DNA or RNA by identification of a protospacer adjacent motif 5'-YTN-3' in contrast to the G-rich PAM targeted by Cas9. After identification of PAM, Cpf1 introduces a sticky-end-like DNA double-stranded break of 4 or 5 nucleotides overhang.

Fusion Proteins Comprising Two napDNAbp, a Deaminase Domain

Some aspects of the disclosure provide fusion proteins comprising a napDNAbp domain having nickase activity (e.g., nCas domain) and a catalytically inactive napDNAbp (e.g., dCas domain) and a nucleobase editor (e.g., adenosine deaminase domain, cytidine deaminase domain), where at least the napDNAbp domains are joined by a linker. It should be appreciated that the Cas domains may be any of the Cas domains or Cas proteins (e.g., dCas9 and nCas9) provided herein. In some embodiments, any of the Cas domains, DNA binding protein domains, or Cas proteins include, without limitation, Cas9 (e.g., dCas9 and nCas9), Cas12a/Cpf1, Cas12b/C2cl, Cas12c/C2c3, Cas12d/CasY, Cas12e/CasX, Cas12g, Cas12h, and Cas12i. One example of a programmable polynucleotide-binding protein that has different PAM specificity than Cas9 is Clustered Regularly Interspaced Short Palindromic Repeats from *Prevotella* and Francisellal (Cpf1). Similar to Cas9, Cpf1 is also a class 2 CRISPR effector. For example and without limitation, in some embodiments, the fusion protein comprises the structure, where the deaminase is adenosine deaminase or cytidine deaminase:

$NH_2$-[deaminase]-[nCas domain]-[dCas domain]-COOH;
$NH_2$-[deaminase]-[dCas domain]-[nCas domain]-COOH;
$NH_2$-[nCas domain]-[dCas domain]-[deaminase]-COOH;
$NH_2$-[dCas domain]-[nCas domain]-[deaminase]-COOH;
$NH_2$-[nCas domain]-[deaminase]-[dCas domain]-COOH;
$NH_2$-[dCas domain]-[deaminase]-[nCas domain]-COOH;

In some embodiments, the "-" used in the general architecture above indicates the presence of an optional linker. In some embodiments, the deaminase and a napDNAbp (e.g., Cas domain) are not joined by a linker sequence, but are directly fused. In some embodiments, a linker is present between the deaminase domain and the napDNAbp. In some embodiments, the deaminase or other nucleobase editor is directly fused to dCas and a linker joins dCas and nCas9. In some embodiments, the deaminase and the napDNAbps are fused via any of the linkers provided herein. For example, in some embodiments the deaminase and the napDNAbp are fused via any of the linkers provided below in the section entitled "Linkers". In some embodiments, the dCas domain and the deaminase are immediately adjacent and the nCas domain is joined to these domains (either 5' or 3') via a linker.

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The PAM sequence is essential for target binding, but the exact sequence depends on a type of Cas protein.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities. For example, typically Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length. Several PAM variants are described in Table 1.

In some embodiments, the SpCas9 has specificity for PAM nucleic acid sequence 5'-NGC-3' or 5'-NGG-3'. In various embodiments of the above aspects, the SpCas9 is a Cas9 or Cas9 variant listed in Table 1. In various embodiments of the above aspects, the modified SpCas9 is spCas9-MQKFRAER. In some embodiments, the variant Cas protein can be spCas9, spCas9-VRQR, spCas9-VRER, xCas9 (sp), saCas9, saCas9-KKH, SpCas9-MQKFRAER, spCas9-MQKSER, spCas9-LRKIQK, or spCas9-LRVSQL. In one specific embodiment, a modified SpCas9 including amino acid substitutions D1135M, S1136Q, G1218K, E1219F, A1322R, D1332A, R1335E, and T1337R (SpCas9-MQKFRAER) and having specificity for the altered PAM 5'-NGC-3' is used.

In some embodiments, the PAM is NGT. In some embodiments, the NGT PAM is a variant. In some embodiments, the NGT PAM variant is created through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Tables 2 and 3 below.

TABLE 2

NGT PAM Variant Mutations at residues 1219, 1335, 1337, 1218

| Variant | E1219V | R1335Q | T1337 | G1218 |
|---|---|---|---|---|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |
| 24 | I | A | W | |
| 25 | I | A | F | |
| 26 | I | A | Y | |

TABLE 3

NGT PAM Variant Mutations at residues 1135, 1136, 1218, 1219, and 1335

| Variant | D1135L | S1136R | G1218S | E1219V | R1335Q |
|---|---|---|---|---|---|
| 27 | G | | | | |
| 28 | V | | | | |
| 29 | I | | | | |

TABLE 3-continued

NGT PAM Variant Mutations at residues 1135, 1136, 1218, 1219, and 1335

| Variant | D1135L | S1136R | G1218S | E1219V | R1335Q |
|---|---|---|---|---|---|
| 30 | A | | | | |
| 31 | W | | | | |
| 32 | H | | | | |
| 33 | K | | | | |
| 34 | | K | | | |
| 35 | | R | | | |
| 36 | | Q | | | |
| 37 | | T | | | |
| 38 | | N | | | |
| 39 | | | I | | |
| 40 | | | A | | |
| 41 | | | N | | |
| 42 | | | Q | | |
| 43 | | | G | | |
| 44 | | | L | | |
| 45 | | | S | | |
| 46 | | | T | | |
| 47 | | | | L | |
| 48 | | | | I | |
| 49 | | | | V | |
| 50 | | | | N | |
| 51 | | | | S | |
| 52 | | | | T | |
| 53 | | | | F | |
| 54 | | | | Y | |
| 55 | N1286Q | I1331F | | | |

In some embodiments, the NGT PAM variant is selected from variant 5, 7, 28, 31, or 36 in Tables 2 and 3. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 4 below.

TABLE 4

NGT PAM Variant Mutations at residues 1219, 1335, 1337, and 1218

| Variant | E1219V | R1335Q | T1337 | G1218 |
|---|---|---|---|---|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, the NGT PAM is selected from the variants provided in Table 5 below.

TABLE 5

NGT PAM variants

| NGTN variant | | D1135 | S1136 | G1218 | E1219 | A1322R | R1335 | T1337 |
|---|---|---|---|---|---|---|---|---|
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein may be fused with any of the cytidine deaminases 10 or adenosine deaminases provided herein In some embodiments, the SpCas9 domain comprises one or more of a D1135X, a R1335X, and a T1336X mutation, or a corresponding mutation in any of the amino acid sequences provided herein, wherein X is any amino acid. In some embodiments, the SpCas9 domain comprises one or more of a D1135E, R1335Q, and T1336R mutation, or a corresponding mutation in any of the amino acid sequences provided herein. In some embodiments, the SpCas9 domain comprises a D1135E, a R1335Q, and a T1336R mutation, or corresponding mutations in any of the amino acid sequences provided herein. In some embodiments, the SpCas9 domain comprises one or more of a D1135X, a R1335X, and a T1336X mutation, or a corresponding mutation in any of the amino acid sequences provided herein, wherein X is any amino acid. In some embodiments, the SpCas9 domain comprises one or more of a D1135V, a R1335Q, and a T1336R mutation, or a corresponding mutation in any of the amino acid sequences provided herein. In some embodiments, the SpCas9 domain comprises a D1135V, a R1335Q, and a T1336R mutation, or corresponding mutations in any of the amino acid sequences provided herein. In some embodiments, the SpCas9 domain comprises one or more of a D1135X, a G1217X, a R1335X, and a T1336X mutation, or a corresponding mutation in any of the amino acid sequences provided herein, wherein X is any amino acid. In some embodiments, the SpCas9 domain comprises one or more of a D1135V, a G1217R, a R1335Q, and a T1336R mutation, or a corresponding mutation in any of the amino acid sequences provided herein. In some embodiments, the SpCas9 domain comprises a D1135V, a G1217R, a R1335Q, and a T1336R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4 kilobase (kb) coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of *S. thermophilus* (5'-NNAGAA for CRISPR1 and 5'-NGGNG for CRISPR3) and *Neisseria meningiditis* (5'-NNNNGATT) can also be found adjacent to a target gene.

In some embodiments, for a *S. pyogenes* system, a target gene sequence can precede (i.e., be 5' to) a 5'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

The amino acid sequence of an exemplary PAM-binding SpCas9 is as follows:

(SEQ ID NO: 111)

MDKKYSIGLDIGTNSVGWAVITDEYKVPSKK
FKVLGNTDRHSIKKNLIGALLFDSGETAEAT
RLKRTARRRYTRRKNRICYLQEIFSNEMAKV
DDSFFHRLEESFLVEEDKKHERHPIFGNIVD
EVAYHEKYPTIYHLRKKLVDSTDKADLRLIY
LALAHMIKFRGHFLIEGDLNPDNSDVDKLFI
QLVQTYNQLFEENPINASGVDAKAILSARLS
KSRRLENLIAQLPGEKKNGLFGNLIALSLGL
TPNFKSNFDLAEDAKLQLSKDTYDDDLDNLL
AQIGDQYADLFLAAKNLSDAILLSDILRVNT
EITKAPLSASMIKRYDEHHQDLTLLKALVRQ
QLPEKYKEIFFDQSKNGYAGYIDGGASQEEF
YKFIKPILEKMDGTEELLVKLNREDLLRKQR
TFDNGSIPHQIHLGELHAILRRQEDFYPFLK
DNREKIEKILTFRIPYYVGPLARGNSRFAWM
TRKSEETITPWNFEEVVDKGASAQSFIERMT
NFDKNLPNEKVLPKHSLLYEYFTVYNELTKV
KYVTEGMRKPAFLSGEQKKAIVDLLFKTNRK
VTVKQLKEDYFKKIECFDSVEISGVEDRFNA
SLGTYHDLLKIIKDKDFLDNEENEDILEDIV
LTLTLFEDREMIEERLKTYAHLFDDKVMKQL
KRRRYTGWGRLSRKLINGIRDKQSGKTILDF
LKSDGFANRNFMQLIHDDSLTFKEDIQKAQV
SGQGDSLHEHIANLAGSPAIKKGILQTVKVV
DELVKVMGRHKPENIVIEMARENQTTQKGQK
NSRERMKRIEEGIKELGSQILKEHPVENTQL
QNEKLYLYYLQNGRDMYVDQELDINRLSDYD
VDHIVPQSFLKDDSIDNKVLTRSDKNRGKSD
NVPSEEVVKKMKNYWRQLLNAKLITQRKFDN
LTKAERGGLSELDKAGFIKRQLVETRQITKH
VAQILDSRMNTKYDENDKLIREVKVITLKSK
LVSDFRKDFQFYKVREINNYHHAHDAYLNAV
VGTALIKKYPKLESEFVYGDYKVYDVRKMIA
KSEQEIGKATAKYFFYSNIMNFFKTEITLAN
GEIRKRPLIETNGETGEIVWDKGRDFATVRK
VLSMPQVNIVKKTEVQTGGFSKESILPKRNS
DKLIARKKDWDPKKYGGFDSPTVAYSVLVVA
KVEKGKSKKLKSVKELLGITIMERSSFEKNP
IDFLEAKGYKEVKKDLIIKLPKYSLFELENG
RKRMLASAGELQKGNELALPSKYVNFLYLAS
HYEKLKGSPEDNEQKQLFVEQHKHYLDEIIE
QISEFSKRVILADANLDKVLSAYNKHRDKPI
REQAENIIHLFTLTNLGAPAAFKYFDTTIDR
KRYTSTKEVLDATLIHQSITGLYETRIDLSQ
LGGD.

The amino acid sequence of an exemplary PAM-binding SpCas9n is as follows:

(SEQ ID NO: 112)

MDKKYSIGLAIGTNSVGWAVITDEYKVPSKK
FKVLGNTDRHSIKKNLIGALLFDSGETAEAT
RLKRTARRRYTRRKNRICYLQEIFSNEMAKV
DDSFFHRLEESFLVEEDKKHERHPIFGNIVD
EVAYHEKYPTIYHLRKKLVDSTDKADLRLIY
LALAHMIKFRGHFLIEGDLNPDNSDVDKLFI
QLVQTYNQLFEENPINASGVDAKAILSARLS
KSRRLENLIAQLPGEKKNGLFGNLIALSLGL
TPNFKSNFDLAEDAKLQLSKDTYDDDLDNLL
AQIGDQYADLFLAAKNLSDAILLSDILRVNT
EITKAPLSASMIKRYDEHHQDLTLLKALVRQ
QLPEKYKEIFFDQSKNGYAGYIDGGASQEEF
YKFIKPILEKMDGTEELLVKLNREDLLRKQR
TFDNGSIPHQIHLGELHAILRRQEDFYPFLK
DNREKIEKILTFRIPYYVGPLARGNSRFAWM
TRKSEETITPWNFEEVVDKGASAQSFIERMT
NFDKNLPNEKVLPKHSLLYEYFTVYNELTKV
KYVTEGMRKPAFLSGEQKKAIVDLLFKTNRK
VTVKQLKEDYFKKIECFDSVEISGVEDRFNA
SLGTYHDLLKIIKDKDFLDNEENEDILEDIV
LTLTLFEDREMIEERLKTYAHLFDDKVMKQL
KRRRYTGWGRLSRKLINGIRDKQSGKTILDF
LKSDGFANRNFMQLIHDDSLTFKEDIQKAQV
SGQGDSLHEHIANLAGSPAIKKGILQTVKVV
DELVKVMGRHKPENIVIEMARENQTTQKGQK
NSRERMKRIEEGIKELGSQILKEHPVENTQL
QNEKLYLYYLQNGRDMYVDQELDINRLSDYD
VDHIVPQSFLKDDSIDNKVLTRSDKNRGKSD
NVPSEEVVKKMKNYWRQLLNAKLITQRKFDN
LTKAERGGLSELDKAGFIKRQLVETRQITKH
VAQILDSRMNTKYDENDKLIREVKVITLKSK

-continued

LVSDFRKDFQFYKVREINNYHHAHDAYLNAV

VGTALIKKYPKLESEFVYGDYKVYDVRKMIA

KSEQEIGKATAKYFFYSNIMNFFKTEITLAN

GEIRKRPLIETNGETGEIVWDKGRDFATVRK

VLSMPQVNIVKKTEVQTGGFSKESILPKRNS

DKLIARKKDWDPKKYGGFDSPTVAYSVLVVA

KVEKGKSKKLKSVKELLGITIMERSSFEKNP

IDFLEAKGYKEVKKDLIIKLPKYSLFELENG

RKRMLASAGELQKGNELALPSKYVNFLYLAS

HYEKLKGSPEDNEQKQLFVEQHKHYLDEIIE

QISEFSKRVILADANLDKVLSAYNKHRDKPI

REQAENIIHLFTLTNLGAPAAFKYFDTTIDR

KRYTSTKEVLDATLIHQSITGLYETRIDLSQ

LGGD.

The amino acid sequence of an exemplary PAM-binding SpEQR Cas9 is as follows: MDKKYSIGLAIGTNSVGWAVITDEYKVPSKKFKVLGNTDRHSIKKNLIGALLFDSGETAEAT RLKRTARRRYTRRKNRICYLQEIFSNEMAKVDDSFFHRLEESFVEEDKKHERHPIFGNIVDEVAYHEKYPTIYHLRKKLVDSTDKADLRLIYLALAHMIKFRGHFLIEGDLNPDNSDVDKLFIQ LVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTE ITKAPLSASMIKRYDEHHQDLTLLKALVRQQLPEKYKEIFFDQSKNGYAGYIDGGASQEEFYKFIKPILEKMDGTEELLVKLNREDLLRKORTFDNGSIPHQIHLGELHAILRRQEDFYPFLKDNREKIEKILTFRIPYYVGPLARGNSRFAWMTRKSEETITPWNFEEVVDKGASAQSFIERMTN FDKNLPNEKVLPKHSLLYEYFTVYNELTKVKYVTEGMRKPAFLSGEQKKAIVDLLFKTNRKV TVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENOTTQKGQKNSRERMKRIEEGIKELGSQILKEHPVENTQLQ NEKLYLYYLQNGRDMYVDQELDINRLSDYDVDHIVPQSFLKDDSIDNKVLTRSDKNRGKSDNVPSEEVVKKMKNYWRQLLNAKLITORKFDNLTKAERGGLSELDKAGFIKRQLVETRQITKHVAQILDSRMNTKYDENDKLIREVKVITLKSKLVSDFRKDFQFYKVREINNYHHAHDAYLNAVV GTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIR EQAENIIHLFTLTNLGAPAAFKYFDTTIDRKQYRSTKEVLDATLIHQSITGLYETRIDLSQL GGD (SEQ ID NO: 113). In this sequence, residues E1135, Q1335 and R1337, which can be mutated from D1135, R1335, and T1337 to yield a SpEQR Cas9, are underlined and in bold.

The amino acid sequence of an exemplary PAM-binding SpVQR Cas9 is as follows: MDKKYSIGLAIGTNSVGWAVITDEYKVPSKKFKVLGNTDRHSIKKNLIGALLFDSGETAEAT RLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFI QLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNT EITKAPLSASMIKRYDEHHQDLTLLKALVRQQLPEKYKEIFFDQSKNGYAGYIDGGASQEEFYKFIKPILEKMDGTEELLVKLNREDLLRKORTFDNGSIPHQIHLGELHAILRRQEDFYPFLKDNREKIEKILTFRIPYYVGPLARGNSRFAWMTRKSEETITPWNFEEVVDKGASAQSFIERMT NFDKNLPNEKVLPKHSLLYEYFTVYNELTKVKYVTEGMRKPAFLSGEQKKAIVDLLFKTNRK VTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDF LKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQL QNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKROLVETRQITKH VAQILDSRMNTKYDENDKLIREVKVITLKSKLVSDFRKDFQFYKVREINNYHHAHDAYLNAV VGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPI REQAENIIHLFTLTNLGAPAAFKYFDTTIDRKQYRSTKEVLDATLIHQSITGLYETRIDLSQ LGGD (SEQ ID NO: 114). In this sequence, residues V1135, Q1335, and R1336, which can be mutated from D1135, R1335, and T1336 to yield a SpVQR Cas9, are underlined and in bold.

The amino acid sequence of an exemplary PAM-binding SpVRER Cas9 is as follows:

(SEQ ID NO: 115)

MDKKYSIGLAIGTNSVGWAVITDEYKVPSKK

FKVLGNTDRHSIKKNLIGALLFDSGETAEAT

RLKRTARRRYTRRKNRICYLQEIFSNEMAKV

```
DDSFFHRLEESFLVEEDKKHERHPIFGNIVD
EVAYHEKYPTIYHLRKKLVDSTDKADLRLIY
LALAHMIKFRGHFLIEGDLNPDNSDVDKLFI
QLVQTYNQLFEENPINASGVDAKAILSARLS
KSRRLENLIAQLPGEKKNGLFGNLIALSLGL
TPNFKSNFDLAEDAKLQLSKDTYDDDLDNLL
AQIGDQYADLFLAAKNLSDAILLSDILRVNT
EITKAPLSASMIKRYDEHHQDLTLLKALVRQ
QLPEKYKEIFFDQSKNGYAGYIDGGASQEEF
YKFIKPILEKMDGTEELLVKLNREDLLRKQR
TFDNGSIPHQIHLGELHAILRRQEDFYPFLK
DNREKIEKILTFRIPYYVGPLARGNSRFAWM
TRKSEETITPWNFEEVVDKGASAQSFIERMT
NFDKNLPNEKVLPKHSLLYEYFTVYNELTKV
KYVTEGMRKPAFLSGEQKKAIVDLLFKTNRK
VTVKQLKEDYFKKIECFDSVEISGVEDRFNA
SLGTYHDLLKIIKDKDFLDNEENEDILEDIV
LTLTLFEDREMIEERLKTYAHLFDDKVMKQL
KRRRYTGWGRLSRKLINGIRDKQSGKTILDF
LKSDGFANRNFMQLIHDDSLTFKEDIQKAQV
SGQGDSLHEHIANLAGSPAIKKGILQTVKVV
DELVKVMGRHKPENIVIEMARENQTTQKGQK
NSRERMKRIEEGIKELGSQILKEHPVENTQL
QNEKLYLYYLQNGRDMYVDQELDINRLSDYD
VDHIVPQSFLKDDSIDNKVLTRSDKNRGKSD
NVPSEEVVKKMKNYWRQLLNAKLITQRKFDN
LTKAERGGLSELDKAGFIKRQLVETRQITKH
VAQILDSRMNTKYDENDKLIREVKVITLKSK
LVSDFRKDFQFYKVREINNYHHAHDAYLNAV
VGTALIKKYPKLESEFVYGDYKVYDVRKMIA
KSEQEIGKATAKYFFYSNIMNFFKTEITLAN
GEIRKRPLIETNGETGEIVWDKGRDFATVRK
VLSMPQVNIVKKTEVQTGGFSKESILPKRNS
DKLIARKKDWDPKKYGGFVSPTVAYSVLVVA
KVEKGKSKKLKSVKELLGITIMERSSFEKNP
IDFLEAKGYKEVKKDLIIKLPKYSLFELENG
RKRMLASARELQKGNELALPSKYVNFLYLAS
HYEKLKGSPEDNEQKQLFVEQHKHYLDEIIE
QISEFSKRVILADANLDKVLSAYNKHRDKPI
REQAENIIHLFTLTNLGAPAAFKYFDTTIDR
KEYRSTKEVLDATLIHQSITGLYETRIDLSQ
LGGD.
```

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a SpyMacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMacCas9 domain, the SpCas9d domain, or the SpCas9n domain can bind to a nucleic acid sequence having a NAA PAM sequence.

```
Exemplary SpyMacCas9
                            (SEQ ID NO: 116)
MDKKYSIGLDIGTNSVGWAVITDDYKVPSKK
FKVLGNTDRHSIKKNLIGALLFGSGETAEAT
RLKRTARRRYTRRKNRICYLQEIFSNEMAKV
DDSFFHRLEESFLVEEDKKHERHPIFGNIVD
EVAYHEKYPTIYHLRKKLADSTDKADLRLIY
LALAHMIKFRGHFLIEGDLNPDNSDVDKLFI
QLVQIYNQLFEENPINASRVDAKAILSARLS
KSRRLENLIAQLPGEKRNGLFGNLIALSLGL
TPNFKSNFDLAEDAKLQLSKDTYDDDLDNLL
AQIGDQYADLFLAAKNLSDAILLSDILRVNS
EITKAPLSASMIKRYDEHHQDLTLLKALVRQ
QLPEKYKEIFFDQSKNGYAGYIDGGASQEEF
YKFIKPILEKMDGTEELLVKLNREDLLRKQR
TFDNGSIPHQIHLGELHAILRRQEDFYPFLK
DNREKIEKILTFRIPYYVGPLARGNSRFAWM
TRKSEETITPWNFEEVVDKGASAQSFIERMT
NFDKNLPNEKVLPKHSLLYEYFTVYNELTKV
KYVTEGMRKPAFLSGEQKKAIVDLLFKTNRK
VTVKQLKEDYFKKIECFDSVEISGVEDRFNA
SLGAYHDLLKIIKDKDFLDNEENEDILEDIV
LTLTLFEDRGMIEERLKTYAHLFDDKVMKQL
KRRRYTGWGRLSRKLINGIRDKQSGKTILDF
LKSDGFANRNFMQLIHDDSLTFKEDIQKAQV
SGQGHSLHEQIANLAGSPAIKKGILQTVKIV
DELVKVMGHKPENIVIEMARENQTTQKGQKN
SRERMKRIEEGIKELGSQILKEHPVENTQLQ
NEKLYLYYLQNGRDMYVDQELDINRLSDYDV
DHIVPQSFIKDDSIDNKVLTRSDKNRGKSDN
```

-continued

```
VPSEEVVKKMKNYWRQLLNAKLITQRKFDNL

TKAERGGLSELDKAGFIKRQLVETRQITKHV

AQILDSRMNTKYDENDKLIREVKVITLKSKL

VSDFRKDFQFYKVREINNYHHAHDAYLNAVV

GTALIKKYPKLESEFVYGDYKVYDVRKMIAK

SEQEIGKATAKYFFYSNIMNFFKTEITLANG

EIRKRPLIETNGETGEIVWDKGRDFATVRKV

LSMPQVNIVKKTEIQTVGQNGGLFDDNPKSP

LEVITSKLVPLKKELNPKKYGGYQKPITAYP

VLLITDTKQLIPISVMNKKQFEQNPVKFLR

DRGYQQVGKNDFIKLPKYTLVDIGDGIKRL

WASSKEIHKGNQLVVSKKSQILLYHAHHLD

SDLSNDYLQNHNQQFDVLFNEIISFSKKCK

LGKEHIQKIENVYSNKKNSASIEELAESFI

KLLGFTQLGATSPFNFLGVKLNQKQYKGKK

DYILPCTEGTLIRQSITGLYETRVDLSKIG

ED.
```

In some cases, a variant Cas9 protein harbors, H840A, P475A, W476A, N477A, D1125A, W1126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of Staphylococcus aureus CRISPR-Cas9 by modifying PAM recognition" Nature Biotechnology 33, 1293-1298 (2015); the entire contents of each are hereby incorporated by reference.

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFES PKKKRKV (SEQ ID NO: 117), KRTADGSEFESPKKKRKV (SEQ ID NO: 118), KRPAATKKAGQAKKKK (SEQ ID NO: 119), KKTELQTTNAENKTKKL (SEQ ID NO: 120), KRGIN-DRNFWRGENGRKTR (SEQ ID NO: 121), RKSGKI-AAIVVKRPRKPKKKRKV (SEQ ID NO: 122), or MDSLLMNRRKFLYQFKNVRWAKGRRETYLC (SEQ ID NO: 123).

In some embodiments, the general architecture of exemplary fusion proteins with a deaminase, a nCas9 domain, and a dCas9 domain comprises any one of the following structures, where NLS is a nuclear localization sequence (e.g., any NLS provided herein), $NH_2$ is the N-terminus of the fusion protein, and COOH is the C-terminus of the fusion protein:

$NH_2$-NLS-[deaminase]-[nCas domain]-[dCas domain]-COOH;

$NH_2$-NLS-[deaminase]-[dCas domain]-[nCas domain]-COOH;

$NH_2$-NLS-[nCas domain]-[dCas domain]-[deaminase]-COOH;

$NH_2$-NLS-[dCas domain]-[nCas domain]-[deaminase]-COOH;

$NH_2$-NLS-[nCas domain]-[deaminase]-[dCas domain]-COOH;

$NH_2$-NLS-[dCas domain]-[deaminase]-[nCas domain]-COOH;

NH$_2$-[deaminase]-[nCas domain]-[dCas domain]-NLS—COOH;
NH$_2$-[deaminase]-[dCas domain]-[nCas domain]-NLS—COOH;
NH$_2$-[nCas domain]-[dCas domain]-[deaminase]-NLS—COOH;
NH$_2$-[dCas domain]-[nCas domain]-[deaminase]-NLS—COOH;
NH$_2$-[nCas domain]-[deaminase]-[dCas domain]-NLS—COOH;
NH$_2$-[dCas domain]-[deaminase]-[nCas domain]-NLS—COOH;

In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite-2 parts, while monopartite NLSs are not). The NLS of nucleoplasmin, KR[PAATKKAGQA]KKKK (SEQ ID NO: 124), is the prototype of the ubiquitous bipartite signal: two clusters of basic amino acids, separated by a spacer of about 10 amino acids. The sequence of an exemplary bipartite NLS follows:
PKKKRKVEGADKRTADGSEFESPKKKRKV (SEQ ID NO: 117)

In some embodiments, the fusion proteins comprising a deaminase, a nCas domain, a dCas domain and an NLS do not comprise a linker sequence. In some embodiments, linker sequences between one or more of the domains or proteins (e.g., deaminase, nCas, dCas or NLS) are present.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FLASH tags, V5 tags, and SBP-tags. Additional suitable sequences will be apparent to those of skill in the art. In some embodiments, the fusion protein comprises one or more His tags.

Linkers

In certain embodiments, linkers may be used to link any of the peptides or peptide domains of the invention. The linker may be as simple as a covalent bond, or it may be a polymeric linker many atoms in length. The linker may be a peptide linker or a non-peptide linker. In certain embodiments, the linker may be a UV-cleavable linker. In some embodiments, the linker may be a polynucleotide linker, e.g. a RNA linker. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the deaminase, the napDNAbp having nickase activity, and the catalytically inactive napDNAbp are fused via linkers that comprise 4, 16, 32, 64, or 104 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 61, 62, 63, 64, 65, 70, 75, 80, 85, 90, 95, or 100) amino acids in length. In some embodiments, any of the fusion proteins provided herein, comprise a cytidine deaminase or an adenosine deaminase, a nCas9 domain and a dCas9 domain, each of which is fused to the other via a linker. Various linker lengths and flexibilities between the nCas9 domain and the dCas9 domain can be employed (e.g., ranging from very flexible linkers of the form (GGGS)$_n$ (SEQ ID NO: 125), (GGGGS)$_n$ (SEQ ID NO: 126), and (G)$_n$ to more rigid linkers of the form (EAAAK)$_n$ (SEQ ID NO: 127), (SGGS) n (SEQ ID NO: 128), SGSETPGTSESATPES (SEQ ID NO: 64) (see, e.g., Guilinger J P, Thompson D B, Liu D R. Fusion of catalytically inactive Cas9 to FokI nuclease improves the specificity of genome modification. Nat. Biotechnol. 2014; 32 (6): 577-82; the entire contents are incorporated herein by reference) and (XP)$_n$) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a (GGS)$_n$ motif, wherein n is 1, 3, or 7 (SEQ ID NO: 129). In some embodiments, the dCas9 domain and the nCas9 domain of the fusion proteins provided herein are fused via a linker comprising the amino acid sequence SGSETPGTSESATPES (SEQ ID NO: 64).

Crispr-Cas Protein Complexes with Guide RNAs

Some aspects of this disclosure provide complexes comprising any of the fusion proteins provided herein, and a guide RNA bound to a dCas domain of the fusion protein, where the nCas and the dCas are joined by a linker, and the nucleobase editor (e.g., adenine or cytidine deaminase) is guided to the target site by the dCas. These complexes are also termed ribonucleoproteins (RNPs). In some embodiments, the dCas is immediately adjacent to the nucleobase editor domain (e.g., adenine or cytidine deaminase). In some embodiments, the nucleobase editor domain is 5' of the dCas. In some embodiments, the nucleobase editor domain is 3' of the dCas. In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 1). In some embodiments, the guide nucleic acid (e.g., guide RNA) is complementary to a sequence associated with a disease or disorder.

Methods of Using Fusion Proteins Comprising a Nucleobase Editor Domain, an nCas and a dCas Domain Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence, which is bound by the dCas is immediately adjacent to a canonical PAM sequence (NGG) and the 3' end of the target sequence that is bound by the nCas is immediately adjacent to a PAM sequence that is not a canonical PAM sequence. In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

In some embodiments, a fusion protein of the invention is used for mutagenizing a target of interest. These mutations may affect the function of the target. For example, when a nucleobase editor is used to target a regulatory region the function of the regulatory region is altered and the expression of the downstream protein is reduced.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a nCas domain, a dCas domain, and a deaminase, or a base editing system comprising a nCas9 domain, a dCas9 domain fused with a deaminase, as disclosed herein, to a target site, e.g., a site comprising a mutation to be edited, it is typically necessary to co-express the fusion protein(s) together with two guide RNAs, e.g., two sgRNAs, one of which guides the nCas while the other guides the dCas, e.g. a first sgRNA guides a dSpCas9 and a second sgRNA guides a SaCas9n. Typically, a first guide RNA comprises a sequence of at least 10 contiguous nucleotides that is complementary to a first target sequence, and a second guide RNA comprises a sequence of at least 10 contiguous nucleotides that is complementary to a second target sequence. In some embodiments, the first target sequence and the second target sequence are immediately adjacent to each other. In some embodiments, the first target sequence and the second target sequence overlap. In some embodiments, the first target sequences and the second target sequence are 1 nucleotide, 2 nucleotides, 3 nucleotides, 4 nucleotides, 5 nucleotides, 6 nucleotides, 7 nucleotides, 8 nucleotides, 9 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24, nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, 40 nucleotides, 41 nucleotides, 42 nucleotides, 43 nucleotides, 44 nucleotides, 45 nucleotides, 46 nucleotides, 47 nucleotides, 48 nucleotides, 49 nucleotides, 50 nucleotides, 51 nucleotides, 52 nucleotides, 53 nucleotides, 54 nucleotides, 55 nucleotides, 56 nucleotides, 57 nucleotides, 58 nucleotides, 59 nucleotides, 60 nucleotides, 61 nucleotides, 62 nucleotides, 63 nucleotides, 64 nucleotides, 65 nucleotides, 66 nucleotides, 67 nucleotides, 68 nucleotides, 69 nucleotides, 70 nucleotides, 71 nucleotides, 72 nucleotides, 73 nucleotides, 74 nucleotides, 75 nucleotides, 76 nucleotides, 77 nucleotides, 78 nucleotides, 79 nucleotides, 80 nucleotides, 81 nucleotides, 82 nucleotides, 83 nucleotides, 84 nucleotides, 85 nucleotides, 86 nucleotides, 87 nucleotides, 88 nucleotides, 89 nucleotides, 90 nucleotides, 91 nucleotides, 92 nucleotides, 93 nucleotides, 94 nucleotides, 95 nucleotides, 96 nucleotides, 97 nucleotides, 98 nucleotides, 99 nucleotides, 100 nucleotides, at least 100 nucleotides, at least 110 nucleotides, at least 120 nucleotides, at least 130 nucleotides, at least 140 nucleotides, at least 150 nucleotides, at least 160 nucleotides, at least 170 nucleotides, at least 180 nucleotides, at least 190 nucleotides, or at least 200 nucleotides apart from each other. In some embodiments, the first target sequence and the second target sequence are on the same strand of the target DNA. In some embodiments, the first target sequence and the second target sequence are on opposition strands of the target DNA.

As explained in more detail elsewhere herein, a guide RNA typically comprises a tracrRNA framework allowing for Cas binding, and a guide sequence, which confers sequence specificity to the Cas:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Base Editor Efficiency

The fusion proteins of the invention improve base editor efficiency by modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., mutations) versus indels. In some embodiments, the base editors provided herein are capable of generating a ratio of intended mutation to indels that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 0.1%, less than 0.5%, less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation in a nucleic acid (e.g. a nucleic acid within a genome of a subject) without generating a significant number of unintended mutations. In some embodiments, an intended mutation is a mutation that is generated by a specific base editor bound to a gRNA, specifically designed to generate the intended mutation. In some embodiments, the intended mutation is a mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended mutations:unintended mutations) that is greater than 1:1. In some embodiments, any of the base editors provided herein are capable of generating a ratio of intended mutations to unintended mutations that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a dCas9 domain fused to a cytidine deaminase or adenosine deaminase, where an nCas9 targets a sequence 5' or 3' of the target site bound by the dCas9) and two guide nucleic acids (e.g., two gRNAs, one of which guides the dCas9 and the other of which guides the nCas9), b) inducing strand separation of said target region, c) converting a first nucleobase of said target nucleobase pair in a single strand of the target region to a second nucleobase, and d) cutting no more than one strand of said target region using the dCas9, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., C·G to T·A; G·C to A·T). In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a dCas9 domain. In some embodiments, the base editor protects or binds the non-edited strand. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In one embodiment, the linker is 32 amino acids in length. In another embodiment, a "long linker" is at least about 60 amino acids in length. In other embodiments, the linker is between about 3-100 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, one napDNAbp domain (e.g., nCas9) domain comprises nickase activity and the other napDNAbp domain does not comprise nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker that separates the dCas9 from the nCas9. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, a deaminase domain is flanked on the 5' end by the nCas9 and is flanked at the 3' end by the dCas9. In some embodiments, a deaminase domain is flanked on the 5' end by the dCas9 and is flanked at the 3' end by the nCas9. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

DNA Binding Protein Domains

The invention is not limited to the use of CRISPR-Cas protein/guide RNA complexes or complexes comprising a CRISPR-Cas variant to provide target specific DNA binding. The skilled artisan will appreciate that virtually any DNA binding protein domain may be fused to a nickase to achieve target specific nucleobase editing. In one embodiment, a Zinc Finger Domain (ZFD) provides sequence specific DNA binding. ZFDs are typically about 30 amino acids in length and are capable of recognizing nucleotide triplets. ZFDs have been designed that are capable of recognizing any of 64 possible trinucleotide repeats. One or more ZFDs may be swapped in for any napDNAbp domain described herein. In one embodiment, the ZFD is a Cys2-Hisz zinc finger protein. See, for example, Urnov et al., "Genome editing with engineered zinc finger nucleases," Nat Rev Genet. 2010 September; 11 (9): 636-46.

In other embodiments, a Zinc Finger (ZF) Nickase replaces a napDNAbp comprising nickase activity. Zinc finger nucleases utilize error-prone nonhomologous end-joining (NHEJ) repair of DNA double-strand breaks (DSBs), which gives rise to randomly generated, unwanted small insertions or deletions (indels) at both on-target and off-target sites. In contrast, ZF nickases are sequence specific DNA-nicking enzymes (nickases) that produce single-strand breaks (SSBs) or nicks, instead of DSBs. These nicks are repaired by error-free homologous recombination (HR). Unlike their corresponding nucleases, zinc finger nickases allow site-specific genome modifications only at the on-target site, without the generation of indels. In particular embodiments, the ZF nickase comprises one FokI nuclease domain comprising a mutation (e.g., Asp450 to Ala) at the active site of the FokI domain, which renders it catalytically inactive, and a second FokI nuclease domain having catalytic activity. Such ZF nickases are described, for example, by Kim et al., Genome Res. 2012 22:1327-1333. In other embodiments, a FokI domain is fused to a DNA binding protein domain as described herein.

Transcription Activator Like Effectors (TALEs) also use DNA binding motifs to direct nucleases to specific polynucleotide targets. Each domain of a TALE recognizes a specific nucleotide. Thus, TALES can be readily designed to recognize virtually any target of interest. A TALE may be swapped in for any napDNAbp described herein. TALEs are known in the art and described, for example, by Joung et al., "TALENs: a widely applicable technology for targeted genome editing," Nat Rev Mol Cell Biol. 2013 January; 14 (1): 49-55.

In other embodiments, an engineered DNA mismatch repair endonuclease MutH is fused to a DNA binding protein domain as described, for example, by Gabsalilow et al., Nucleic Acids Res. 2013 April; 41 (7): e83, which is incorporated herein by reference in its entirety, or a DNA binding protein domain as described herein. In one embodiment, a catalytically inactive variant of the homing endonuclease I-Scel or a DNA-binding domain of a TALE protein (e.g., AvrBs4) is fused to a highly specific nickase, MutH, to form a MutH—I-Scel or TALE-MutH fusion protein that is useful in the methods of the invention.

Expression of Fusion Proteins in a Host Cell

Fusion proteins of the invention may be expressed in virtually any host cell of interest, including but not limited to bacteria, yeast, fungi, insects, plants, and animal cells using routine methods known to the skilled artisan. Fusion proteins are generated by operably linking one or more polynucleotides encoding one or more domains having nucleobase modifying activity (e.g., an adenosine deaminase or cytidine deaminase) to a polynucleotide encoding a napDNAbp to prepare a polynucleotide that encodes a fusion protein of the invention. In some embodiments, a polynucleotide encoding a napDNAbp, and a DNA encoding a domain having nucleobase modifying activity may each be fused with a DNA encoding a binding domain or a binding partner thereof, or both DNAs may be fused with a DNA encoding a separation intein, whereby the nucleic acid sequence-recognizing conversion module and the nucleic acid base converting enzyme are translated in a host cell to form a complex. In these cases, a linker and/or a nuclear localization signal can be linked to a suitable position of one of or both DNAs when desired.

A DNA encoding a protein domain described herein can be obtained by any method known in the art, such as by chemically synthesizing the DNA chain, by PCR, or by the Gibson Assembly method. The advantage of constructing a full-length DNA by chemical synthesis or a combination of PCR method or Gibson Assembly method is that the codons may be optimized to ensure that the fusion protein is expressed at a high level in a host cell. Optimized codons may be selected using the genetic code use frequency database (kazusa. or.jp/codon/index.html), which is disclosed in the home page of Kazusa DNA Research Institute. Once obtained polynucleotides encoding fusion proteins are incorporated into suitable expression vectors.

Suitable expression vectors include *Escherichia coli*-derived plasmids (e.g., pBR322, pBR325, pUC12, pUC13); *Bacillus subtilis*-derived plasmids (e.g., pUB110, pTP5, pC194); yeast-derived plasmids (e.g., pSH19, pSH15); plasmids suitable for expression in insect cells (e.g., pFast-Bac); plasmids suitable for expression in mammalian cells (e.g., pA1-11, pXT1, pRc/CMV, pRc/RSV, pcDNAI/Neo); also bacteriophages, such as lamda phage and the like; other vectors that may be used include insect viral vectors, such as baculovirus and the like (e.g., BmNPV, AcNPV); and viral vectors suitable for expression in a mammalian cell, such as retrovirus, vaccinia virus, adenovirus and the like.

Fusion protein encoding polynucleotides are typically expressed under the control of a suitable promoter that is useful for expression in a desired host cell. For example, when the host is an animal cell, any one of the following promoters are used SR alpha promoter, SV40 promoter, LTR promoter, CMV (cytomegalovirus) promoter, RSV (Rous sarcoma virus) promoter, MoMuLV (Moloney mouse leukemia virus) LTR, HSV-TK (simple herpes virus thymidine kinase) promoter and the like are used. In one embodiment, the promoter is CMV promoter or SR alpha promoter. When the host cell is *Escherichia coli*, any of the following promoters may be used: trp promoter, lac promoter, recA promoter, .lamda.P.sub.L promoter, lpp promoter, T7 promoter and the like. When the host is genus *Bacillus*, any of the following promoters may be used: SPO1 promoter, SPO2 promoter, penP promoter and the like. When the host is a yeast, any of the following promoters may be used: Gal1/10 promoter, PHO5 promoter, PGK promoter, GAP promoter, ADH promoter and the like. When the host is an insect cell, any of the following promoters may be used polyhedrin promoter, P10 promoter and the like. When the host is a plant cell, any of the following promoters may be used: CaMV35S promoter, CaMV19S promoter, NOS promoter and the like.

If desired, the expression vector also includes any one or more of an enhancer, splicing signal, terminator, polyA addition signal, a selection marker (e.g., a drug resistance gene, auxotrophic complementary gene and the like), or a replication origin.

An RNA encoding a protein domain described herein can be prepared by, for example, by transcribing an mRNA in an in vitro transcription system.

A fusion protein of the invention can be expressed by introducing an expression vector encoding a fusion protein into a host cell, and culturing the host cell. Host cells useful in the invention include bacterial cells, yeast, insect cells, mammalian cells and the like.

The genus *Escherichia* includes *Escherichia coli* K12.cndot.DH1 [Proc. Natl. Acad. Sci. USA, 60, 160 (1968)], *Escherichia coli* JM103 [Nucleic Acids Research, 9, 309 (1981)], *Escherichia coli* JA221 [Journal of Molecular Biology, 120, 517 (1978)], *Escherichia coli* HB101 [Journal of Molecular Biology, 41, 459 (1969)], *Escherichia coli* C600 [Genetics, 39, 440 (1954)] and the like.

The genus *Bacillus* includes *Bacillus subtilis* M1114 [Gene, 24, 255 (1983)], *Bacillus subtilis* 207-21 [Journal of Biochemistry, 95, 87 (1984)] and the like.

Yeast useful for expressing fusion proteins of the invention include *Saccharomyces cerevisiae* AH22, AH22R.sup.-, NA87-11A, DKD-5D, 20B-12, *Schizosaccharomyces pombe* NCYC1913, NCYC2036, *Pichia pastoris* KM71 and the like are used.

Fusion proteins are expressed in insect cells using, for example, viral vectors, such as AcNPV. Insect host cells include any of the following cell lines: cabbage armyworm larva-derived established line (*Spodoptera frugiperda* cell; Sf cell), MG1 cells derived from the mid-intestine of Trichoplusiani, High Five, cells derived from an egg of Trichoplusiani, *Mamestra brassicae*-derived cells, Estigmena acrea-derived cells and the like are used. When the virus is BmNPV, cells of a *Bombyx mori*-derived line (*Bombyx mori* N cell; BmN cell) and the like are used. Sf cells include, for example, Sf9 cell (ATCC CRL1711), Sf21 cell [all above, In Vivo, 13, 213-217 (1977)] and the like.

With regard to insects, larva of *Bombyx mori, Drosophila*, cricket and the like are used to express fusion proteins [Nature, 315, 592 (1985)].

Mammalian cell lines may be used to express fusion proteins. Such cell lines include monkey COS-7 cell, monkey Vero cell, Chinese hamster ovary (CHO) cell, dhfr gene-deficient CHO cell, mouse L cell, mouse AtT-20 cell, mouse myeloma cell, rat GH3 cell, human FL cell and the like. Pluripotent stem cells, such as iPS cell, ES cell and the like of human and other mammals, and primary cultured cells prepared from various tissues are used. Furthermore, zebrafish embryo, *Xenopus* oocyte and the like can also be used.

Plant cells may be maintained in culture using methods well known to the skilled artisan. Plant cell culture involves suspending cultured cells, callus, protoplast, leaf segment, root segment and the like, which are prepared from various plants (e.g., s rice, wheat, corn, tomato, cucumber, eggplant, carnations, *Eustoma russellianum*, tobacco, *Arabidopsis thaliana* a.

All the above-mentioned host cells may be haploid (monoploid), or polyploid (e.g., diploid, triploid, tetraploid and the like.

Expression vectors encoding a fusion protein of the invention are introduced into host cells using any transfection method (e.g., using lysozyme, PEG, CaCl2 coprecipitation, electroporation, microinjection, particle gun, lipofection, *Agrobacterium* and the like). The transfection method is selected based on the host cell to be transfected. *Escherichia coli* can be transformed according to the methods described in, for example, Proc. Natl. Acad. Sci. USA, 69, 2110 (1972), Gene, 17, 107 (1982) and the like. Methods for transducing the genus *Bacillus* are described in, for example, Molecular & General Genetics, 168, 111 (1979).

Yeast cells are transduced using methods described in, for example, Methods in Enzymology, 194, 182-187 (1991), Proc. Natl. Acad. Sci. USA, 75, 1929 (1978) and the like. Insect cells are transfected using methods described in, for example, Bio/Technology, 6, 47-55 (1988) and the like.

Mammalian cells are transfected using methods described in, for example, Cell Engineering additional volume 8, New Cell Engineering Experiment Protocol, 263-267 (1995) (published by Shujunsha), and Virology, 52, 456 (1973).

Cells comprising expression vectors of the invention are cultured according to known methods, which vary depending on the host.

For example, when *Escherichia coli* or genus *Bacillus* cells are cultured, a liquid medium is used. The medium preferably contains a carbon source, nitrogen source, inorganic substance and other components necessary for the growth of the transformant. Examples of the carbon source include glucose, dextrin, soluble starch, sucrose and the like; examples of the nitrogen source include inorganic or organic substances such as ammonium salts, nitrate salts, corn steep liquor, peptone, casein, meat extract, soybean cake, potato extract and the like; and examples of the inorganic substance include calcium chloride, sodium dihydrogen phosphate, magnesium chloride and the like. The medium may also contain yeast extract, vitamins, growth promoting factors and the like. The pH of the medium is preferably between about 5 to about 8.

As a medium for culturing *Escherichia coli*, for example, M9 medium containing glucose, casamino acid [Journal of Experiments in Molecular Genetics, 431-433, Cold Spring Harbor Laboratory, New York 1972] is used. *Escherichia coli* is cultured at generally about 15-about 43° C. Where necessary, aeration and stirring may be performed.

The genus *Bacillus* is cultured at generally about 30 to about 40° C. Where necessary, aeration and stirring is performed.

Examples of medium suitable for culturing yeast include Burkholder minimum medium [Proc. Natl. Acad. Sci. USA, 77, 4505 (1980)], SD medium containing 0.5% casamino acid [Proc. Natl. Acad. Sci. USA, 81, 5330 (1984)] and the like. The pH of the medium is preferably about 5-about 8. The culture is performed at generally about 20° C. to about 35° C. Where necessary, aeration and stirring may be performed.

As a medium for culturing an insect cell or insect, Grace's Insect Medium [Nature, 195, 788 (1962)] containing an additive such as inactivated 10% bovine serum and the like are used. The pH of the medium is preferably about 6.2 to about 6.4. Cells are cultured at about 27° C. Where necessary, aeration and stirring may be performed.

Mammalian cells are cultured, for example, in any one of minimum essential medium (MEM) containing about 5 to about 20% of fetal bovine serum [Science, 122, 501 (1952)], Dulbecco's modified Eagle medium (DMEM) [Virology, 8, 396 (1959)], RPMI 1640 medium [The Journal of the American Medical Association, 199, 519 (1967)], 199 medium [Proceeding of the Society for the Biological Medicine, 73, 1 (1950)] and the like. The pH of the medium is preferably about 6 to about 8. The culture is performed at about 30° C. to about 40° C. Where necessary, aeration and stirring may be performed.

As a medium for culturing a plant cell, for example, MS medium, LS medium, B5 medium and the like are used. The pH of the medium is preferably about 5 to about 8. The culture is performed at generally about 20° C. to about 30° C. Where necessary, aeration and stirring may be performed.

Fusion protein expression may be regulated using an inducible promoter (e.g., metallothionein promoter (induced by heavy metal ion), heat shock protein promoter (induced by heat shock), Tet-ON/Tet-OFF system promoter (induced by addition or removal of tetracycline or a derivative thereof), steroid-responsive promoter (induced by steroid hormone or a derivative thereof) etc.), the inducing agent is added to the medium (or removed from the medium) at an appropriate stage to induce expression of the fusion protein.

Prokaryotic cells such as *Escherichia coli* and the like can utilize an inductive promoter. Examples of the inducible promoters include, but are not limited to, lac promoter (induced by IPTG), cspA promoter (induced by cold shock), araBAD promoter (induced by arabinose) and the like.

Nucleic Acid-Based Delivery of a Nucleobase Editor

Nucleic acids encoding nucleobase editors according to the present disclosure can be administered to subjects or delivered into cells (e.g., bacteria, yeast, fungi, insects, plants, and animal cells) by art-known methods or as described herein. For example, nucleobase editors can be delivered by, e.g., vectors (e.g., viral or non-viral vectors), non-vector based methods (e.g., using naked DNA or DNA complexes), or a combination thereof.

Nucleic acids encoding nucleobase editors can be delivered directly to cells (e.g., bacteria, yeast, fungi, insects, plants, and animal cells) as naked DNA or RNA, for instance by means of transfection or electroporation, or can be conjugated to molecules (e.g., N-acetylgalactosamine) promoting uptake by the target cells. Nucleic acid vectors, such as the vectors can also be used.

Nucleic acid vectors can comprise one or more sequences encoding a domain of a fusion protein described herein. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40), and one or more deaminases.

The nucleic acid vector can also include any suitable number of regulatory/control elements, e.g., promoters, enhancers, introns, polyadenylation signals, Kozak consensus sequences, or internal ribosome entry sites (IRES). These elements are well known in the art.

Nucleic acid vectors according to this disclosure include recombinant viral vectors. Exemplary viral vectors are set forth herein above. Other viral vectors known in the art can also be used. In addition, viral particles can be used to deliver genome editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems according to the present disclosure. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 6 (below).

TABLE 6

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |

TABLE 6-continued

Lipids Used for Gene Transfer

| Lipid | Abbreviation | Feature |
|---|---|---|
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl]imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 7 lists exemplary polymers for use in gene transfer and/or nanoparticle formulations.

TABLE 7

Polymers Used for Gene Transfer

| Polymer | Abbreviation |
|---|---|
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-l-proline ester) | PHP |
| Poly(allylamine) | |
| Poly(α-[4-aminobutyl]]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 8 summarizes delivery methods for a polynucleotide encoding a fusion protein described herein.

TABLE 8

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection | YES | Transient | NO | Nucleic Acids and Proteins |
| Viral | Retrovirus | NO | Stable | YES | RNA |
|  | Lentivirus | YES | Stable | YES/NO with modification | RNA |
|  | Adenovirus | YES | Transient | NO | DNA |
|  | Adeno-Associated Virus (AAV) | YES | Stable | NO | DNA |
|  | Vaccinia Virus | YES | Very Transient | NO | DNA |
|  | Herpes Simplex Virus | YES | Stable | NO | DNA |
| Non-Viral | Cationic Liposomes | YES | Transient | Depends on what is delivered | Nucleic Acids and Proteins |
|  | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
|  | Engineered Bacteriophages | YES | Transient | NO | Nucleic Acids |
|  | Mammalian Virus-like Particles | YES | Transient | NO | Nucleic Acids |
|  | Biological liposomes: Erythrocyte Ghosts and Exosomes | YES | Transient | NO | Nucleic Acids |

In particular embodiments, a fusion protein of the invention is encoded by a polynucleotide present in a viral vector (e.g., adeno-associated virus (AAV), AAV3, AAV3b, AAV4, AAV5, AAV6, AAV7, AAV8, AAV9, AAVrh8, AAV10, and variants thereof), or a suitable capsid protein of any viral vector. Thus, in some aspects, the disclosure relates to the viral delivery of a fusion protein. Examples of viral vectors include retroviral vectors (e.g. Maloney murine leukemia virus, MML-V), adenoviral vectors (e.g. AD100), lentiviral vectors (HIV and FIV-based vectors), herpesvirus vectors (e.g. HSV-2).

In one embodiment, inteins are utilized to join fragments or portions of a nucleobase editor protein that is grafted onto an AAV capsid protein. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289 (21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In some embodiments, a portion or fragment of a nuclease (e.g., a fragment of a deaminase, such as cytidine deaminase, adenosine deaminase, or a fragment of Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

Screening of Nucleobase Editors

The suitability of candidate nucleobase editors can be evaluated in various screening approaches. Each fusion protein to be tested is transfected into a cell of interest (e.g., a bacteria, yeast, fungi, insect, plant, or animal cell) together with a small amount of a vector encoding a reporter (e.g., GFP). These cells can be immortalized in human cell lines such as 293T, K562 or U2OS. Alternatively, primary human cells may be used. Such cells may be relevant to the eventual therapeutic cell target.

Transfection may be performed using lipid transfection (such as Lipofectamine or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq).

The fusion proteins that induce the greatest levels of target specific alterations in initial tests can be selected for further evaluation.

In particular embodiments, the nucleobase editors are used to target polynucleotides of interest. In one embodiment, a nucleobase editor is used to target a regulatory sequence, including but not limited to splice sites, enhancers, and transcriptional regulatory elements. The effect of the alteration on the expression of a gene controlled by the regulatory element is then assayed using any method known in the art.

In other embodiments, a nucleobase editor of the invention is used to target a polynucleotide encoding a Complementarity Determining Region (CDR), thereby creating alterations in the expressed CDR. The effect of these alterations on CDR function is then assayed, for example, by measuring the specific binding of the CDR to its antigen.

In still other embodiments, a nucleobase editor of the invention is used to target polynucleotides of interest within the genome of an organism (e.g., bacteria, yeast, fungi, insect, plant, and animal). In one embodiment, a nucleobase editor of the invention is delivered to cells in conjunction with a library of guide RNAs that are used to tile a variety of sequences within the genome of a cell, thereby systematically altering sequences throughout the genome.

Applications for Nucleobase Editors

Nucleobase editors are used to introduce a point mutation into a nucleic acid by deaminating a target nucleobase, e.g., an A or C residue. In some embodiments, the deamination of the target nucleobase results in the correction of a genetic defect, e.g., in the correction of a point mutation that leads to a loss of function in a gene product. In some embodiments, the purpose of the methods provided herein is to restore the function of a dysfunctional gene via genome editing. In particular embodiments, a nucleobase editor of the invention is used to target a polynucleotide of interest within a cell (e.g., a cell in vitro or in vivo). The nucleobase editors can be used to target polynucleotides of interest to create alterations that modify protein expression. In one embodiment, a nucleobase editor is used to modify a non-coding or regulatory sequence, including but not limited to splice sites, enhancers, and transcriptional regulatory elements. The effect of the alteration on the expression of a gene controlled by the regulatory element is then assayed using any method known in the art. In a particular embodiment, a nucleobase editor is able to substantially alter a regulatory sequence, thereby abolishing its ability to regulate gene expression. Advantageously, this can be done without generating double-stranded breaks in the genomic target sequence, in contrast to other RNA-programmable nucleases.

The nucleobase editors can be used to target polynucleotides of interest to create alterations that modify protein activity. In the context of mutagenesis, for example, nucleobase editors have a number of advantages over error-prone PCR and other polymerase-based methods. Unlike error-prone PCR, which induces random alterations throughout a polynucleotide, nucleobase editors of the invention can be used to target specific amino acids within a defined region of a protein of interest.

In other embodiments, nucleobase editor of the invention is used to target a polynucleotide of interest within the genome of an organism. In one embodiment, the organism is a bacteria of the microbiome (e.g., Bacteriodetes, Verrucomicrobia, Firmicutes; Gammaproteobacteria, Alphaproteobacteria, Bacteriodetes, Clostridia, Erysipelotrichia, Bacilli; Enterobacteriales, Bacteriodales, Verrucomicrobiales, Clostridiales, Erysiopelotrichales, Lactobacillusacteriaceae, Bacteroidaceae, Erysiopelotrichaceae, Prevotellaceae, Coriobacteriaceae, and Alcaligenaceae; *Escherichia, Bacteroides, Alistipes, Akkermansia, Clostridium, Lactobacillus*). In another embodiment, the organism is an agriculturally important animal (e.g., cow, sheep, goat, horse, chicken, turkey) or plant (e.g., soybean, wheat, corn, cotton, canola, rice, tobacco, apple, grape, peach, plum, cherry).

The present disclosure provides methods for the treatment of a subject diagnosed with diseases associated with or caused by gene mutations, including gene conversion, point mutations that affect splicing (e.g., alter a splice donor or acceptor site), abberrent or mis-folded proteins due to point mutations that can be corrected by a base editor system provided herein. For example, in some embodiments, a method is provided that comprises administering to a subject having such a disease, e.g., a disease caused by a gene conversion or other genetic mutation, an effective amount of a nucleobase editor (e.g., an adenosine deaminase base editor or a cytidine deaminase base editor, including one or more than one DNA binding protein domains) that edits the nucleoside base directly or indirectly associated with the mutation in the disease associatedgene. In a certain aspect, methods are provided for the treatment of additional diseases or disorders, e.g., diseases or disorders that are associated or caused by a point mutation that can be corrected or ameliorated by deaminase mediated gene editing. Some such diseases are described herein, and additional suitable diseases that can be treated with the strategies and fusion proteins provided herein will be apparent to those of skill in the art based on the instant disclosure.

Pharmaceutical Compositions

Other aspects of the present disclosure relate to pharmaceutical compositions comprising any of the base editors, fusion proteins, or the fusion protein-guide polynucleotide complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

Some nonlimiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient," "carrier," "pharmaceutically acceptable carrier," "vehicle," or the like are used interchangeably herein.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g, tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (See, e.g., Langer, 1990, Science 249:1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et ah, 1989, J. Neurosurg. 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et ah, Gene Ther. 1999, 6:1438-47). Positively charged lipids such as N-[1-(2,3-dioleoyloxi) propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, any of the fusion proteins, gRNAs, systems, and/or complexes described herein are provided as part of a pharmaceutical composition. In some embodiments, the pharmaceutical composition comprises any of the fusion proteins provided herein. In some embodiments, the pharmaceutical composition comprises any of the systems or complexes provided herein. In some embodiments, the pharmaceutical composition comprises a ribonucleoprotein complex comprising an RNA-guided nuclease (e.g., Cas9) or a fragment thereof that forms a complex with a gRNA and a cationic lipid. In some embodiments, the pharmaceutical composition comprises a ribonucleoprotein complex comprising multiple programmable DNA binding proteins (e.g. Cas9, Zinc Finger, TALE, TALE-N proteins or fragments thereof). The programmable DNA binding proteins may comprise nuclease activity, nickase activity, or no nuclease activity. In some embodiments, the pharmaceutical composition comprises a gRNA, a nucleic acid programmable DNA binding protein, a cationic lipid, and a pharmaceutically acceptable excipient. Pharmaceutical compositions as described herein may optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein may be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit.

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication number WO2011053982 A8, filed Nov. 2, 2010), incorporated in its entirety herein by reference, for additional suitable methods, reagents, excipients and solvents for producing pharmaceutical compositions comprising a nuclease. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure. In some embodiments, compositions in accordance with the present invention may be used for treatment of any of a variety of diseases, disorders, and/or conditions.

Kits, Vectors, Cells

Various aspects of this disclosure provide kits that include a nucleobase editor containing a first DNA binding protein domain that is catalytically inactive, a domain containing base editing activity, and a second DNA binding protein domain containing nickase activity. In particular embodiments, the first and second DNA binding protein domains are expressed in a single expression vector or each is expressed in a separate expression vector. In one embodiment, the kit contains a nucleobase editor polypeptide containing a CRISPR-Cas (e.g., Cas9) domain having nickase activity (nCas; e.g., nCas9), a deactivated CRISPR-Cas (e.g., Cas9) domain lacking nickase activity (dCas; e.g., dCas9), and a cytidine or adenosine deaminase domain, wherein the dCas domain and the nCas domains are joined by a linker, and the cytidine deaminase or adenosine deaminase domain is immediately adjacent to dCas, a first single guide RNA that binds nCas and a second single guide RNA that binds dCas, thereby editing the polynucleotide. Some aspects of this disclosure provide kits comprising a nucleic acid construct encoding nucleobase edits described herein.

Some aspects of this disclosure provide cells (e.g., bacteria, yeast, fungi, insects, plants, and animal cells) comprising any of the nucleobase editor/fusion proteins provided herein. In some embodiments, the cells comprise any of the nucleotides or vectors provided herein.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: A Nucleobase Editor Containing nCas9 Linked to dCas9 Linked to Cytidine Deaminase Polynucleotides are generated encoding the following: the S. aureus nCas9, which binds a first PAM sequence; a linker; S. pyogenes dCas9 (D10A and H840A) domain, which binds a different PAM sequence; which is fused immediately adjacent to Pteromyzon marinus cytidine deaminase (pmCDA) domain, which has cytidine deaminase activity; and a bipartite NLS ("nCas9/cytidine deaminase/dCas9/NLS"). The nCas9/cytidine deaminase/dCas9/NLS polynucleotide is cloned into a mammalian expression vector. The vector includes a CMV promoter to drive expression of the fused polynucleotides encoding the nucleobase editor fusion protein. Advantageously, the nCas9 is separated by a linker from the dCas9/cytidine deaminase portion of the fusion protein, and each of these Cas9s is guided to the target site by a guide RNA. This permits the uncoupling of the base editing activity of the dCas9/nucleobase editor complex from the nickase activity of nCas9, which results in the generation of fewer indels. HEK293T cells are transfected with the vector and two appropriate sgRNAs, which guide the dCas9 and the nCas9 to their respective target sites. The activity of the nucleobase editor containing a cytidine deaminase fused to a dCas9 fused via a linker to an nCas9 is compared to a corresponding nucleobase editor containing a cytidine deaminase fused to an nCas9. The cells are allowed five days for nucleobase editing to occur, then genomic DNA is extracted from the cells, and the loci is analyzed by high throughput sequencing. C to T conversions are detected in the genomic DNA. The rate of indel formation is also analyzed. Untreated control cells are incubated under similar conditions, but in the absence of any base editor. The nCas9/cytidine deaminase/dCas9 nucleobase editor shows less indel formation while also maintaining high levels of C to T conversions.

Example 2: A Nucleobase Editor System Containing nCas9 Expressed in Trans with dCas9 Linked to Cytidine Deaminase Polynucleotides are generated encoding the following: the S. aureus nCas9, which binds a first PAM sequence, is fused to a bipartite NLS; the S. pyogenes dCas9 (D10A and H840A) domain, which binds a different PAM sequence; is fused immediately adjacent to Pteromyzon marinus cytidine deaminase (pmCDA) domain, which has cytidine deaminase activity and a bipartite NLS ("cytidine deaminase/dCas9/NLS"). The nCas9/NLS is cloned into a first expression vector and the cytidine deaminase/dCas9 polynucleotide is cloned into a second mammalian expression vector. The vectors include a CMV promoter to drive expression of the encoded proteins. Advantageously, the nCas9 and the dCas9 are each guided to a target site by a guide RNA. This permits the uncoupling of the base editing activity of the dCas9/nucleobase editor from the nickase activity of nCas9, which results in the generation of fewer indels. HEK293T cells are transfected with the vectors and two appropriate sgRNAs, which guide the dCas9 and the nCas9 to their respective target sites. The activity of the nucleobase editor system, which includes a cytidine deaminase fused to a dCas9 and an nCas9 expressed in trans is compared to a corresponding nucleobase editor fusion protein containing a cytidine deaminase and an nCas9. The cells are allowed five days for nucleobase editing to occur, then genomic DNA is extracted from the cells, and the loci is analyzed by high throughput sequencing. C to T conversions are detected in the genomic DNA. The rate of indel formation is also analyzed. Untreated control cells are incubated under similar conditions, but in the absence of any base editor. The nucleobase editor system shows less indel formation while also maintaining high levels of C to T conversions.

Example 3: A Nucleobase Editor Containing nCas9 Linked to dCas9 Linked to Adenosine Deaminase Polynucleotides are generated encoding the following: the S. aureus nCas9, which binds a first PAM sequence; a linker; S. pyogenes dCas9 (D10A and H840A) domain, which binds a different PAM sequence; which is fused immediately adjacent to TadA adenosine deaminase, and a bipartite NLS (nCas9/adenosine deaminase/dCas9/NLS) are cloned into a mammalian expression vector. The vector includes a CMV promoter to drive expression of the fused polynucleotides encoding the nucleobase editor. Advantageously, the nCas9 is separated by a linker from the dCas9, and each of these Cas9s is guided to the target site by a guide RNA. This permits the uncoupling of the base editing activity of the dCas9/nucleobase editor complex from the nickase activity of nCas9, which results in the generation of fewer indels. HEK293T cells are transfected with the vector and two appropriate sgRNAs, which guide the dCas9 and the nCas9 to their respective target sites. The activity of the nucleobase editor containing an adenosine deaminase, a dCas9 and an nCas9 is compared to a corresponding nucleobase editor containing a adenosine deaminase and an nCas9. The cells are allowed five days for nucleobase editing to occur, then genomic DNA is extracted from the cells, and the loci is analyzed by high throughput sequencing. C to T conversions are detected in the genomic DNA. The rate of indel formation is also analyzed. Untreated control cells are incubated under similar conditions, but in the absence of any base editor. The dCas9/adenosine deaminase/nCas9 nucleobase editor shows less indel formation while also maintaining high levels of C to T conversions.

Example 4: A Nucleobase Editor System Containing nCas9 Expressed in Trans with dCas9 Linked to Adenosine Deaminase Polynucleotides are generated encoding the following: the *S. aureus* nCas9, which binds a first PAM sequence and a bipartite NLS ("nCas9/NLS"); *S. pyogenes* dCas9 (D10A and H840A) domain, which binds a different PAM sequence, which is fused immediately adjacent to TadA adenosine deaminase, and a bipartite NLS ("adenosine deaminase/dCas9/NLS"). The nCas9/NLS and the adenosine deaminase/dCas9/NLS are each cloned into separate mammalian expression vectors. Each of the vectors includes a CMV promoter to drive expression of the encoded proteins. Advantageously, the nCas9 is separated from the dCas9, and each of these Cas9s is guided to a target site by a guide RNA. This permits the uncoupling of the base editing activity of the dCas9/nucleobase editor complex from the nickase activity of nCas9, which results in the generation of fewer indels. HEK293T cells are transfected with the vectors and two appropriate sgRNAs, which guide the dCas9 and the nCas9 to their respective target sites. The activity of the nucleobase editor system containing an adenosine deaminase fused to a dCas9 and an nCas9 expressed in trans is compared to a corresponding nucleobase editor fusion protein containing a adenosine deaminase and an nCas9. The cells are allowed five days for nucleobase editing to occur, then genomic DNA is extracted from the cells, and the loci is analyzed by high throughput sequencing. C to T conversions are detected in the genomic DNA. The rate of indel formation is also analyzed. Untreated control cells are incubated under similar conditions, but in the absence of any base editor. The nucleobase editor system shows less indel formation while also maintaining high levels of C to T conversions.

Example 5: Fusion Proteins Containing nCas9 and dCas9

Targeted editing of specific nucleobases in genomic DNA provides a promising approach for the study of gene function and also has the potential to provide new therapies for human genetic diseases. Currently available base editors include cytidine base editors and adenine base editors utilizing Cas9-targeted deamination. BE systems optimized by replacing the Cas9 component with a "nickase" (e.g. Cas9 D10A mutant), which nicks the strand opposite the deaminated cytidine. Without being bound by theory, this is expected to initiate long-patch base excision repair (BER), where the deaminated strand is preferentially used to template the repair to produce a U: A base pair, which is then converted to T: A during DNA replication. Without being bound by theory, creation of an absic site following C-to-U deamination can lead to nicking of the targeted strand DNA-(apurinic or apyrimidinic site) lyase (AP lyase). If the opposite strand has been nicked by the nickase component of the base editor, the resulting proximity of the two nicks may result in a double stranded break, which may be resolved by indel-prone end joining processes. Thus, while base editing efficiency was increased, the number of indels observed also increased. To explore the need for improved base editor systems that generate fewer indels while maintaining high base editing activity, a number of fusion proteins and base editor systems comprising nCas9 and dCas9 linked to deaminase domains are generated. The structures of exemplary fusion proteins are depicted in the schematic in FIG. 1. Amino acid sequences encoding exemplary fusion proteins follow:

NH2-[pmCDA]-[dSpCas9]-[nSaCas9]-UGI-NLS-COOH :

MTDAEYVRIHEKLDIYTFKKQFFNNKKSVSHRCYVLFELKRRGERRACFWGYAVNKPQSG
TERGIHAEIFSIRKVEEYLRDNPGQFTINWYSSWSPCADCAEKILEWYNQELRGNGHTLK
IWACKLYYEKNARNQIGLWNLRDNGVGLNVMVSEHYQCCRKIFIQSSHNQLNENRWLEKT
LKRAEKRRSELSIMIQVKILHTTKSPAV*SGGSSGGSSGSETPGTSESATPESSGGSSGGS*
DKKYSIGLAIGTNSVGWAVITDEYKVPSKKFKVLGNTDRHSIKKNLIGALLFDSGETAEATR
LKRTARRRYTRRKNRICYLQEIFSNEMAKVDDSFFHRLEESFLVEEDKKHERHPIFGNIVDE
VAYHEKYPTIYHLRKKLVDSTDKADLRLIYLALAHMIKFRGHFLIEGDLNPDNSDVDKLFIQ
LVQTYNQLFEENPINASGVDAKAILSARLSKSRRLENLIAQLPGEKKNGLFGNLIALSLGLT
PNFKSNFDLAEDAKLQLSKDTYDDDLDNLLAQIGDQYADLFLAAKNLSDAILLSDILRVNTE
ITKAPLSASMIKRYDEHHQDLTLLKALVRQQLPEKYKEIFFDQSKNGYAGYIDGGASQEEFY
KFIKPILEKMDGTEELLVKLNREDLLRKQRTFDNGSIPHQIHLGELHAILRRQEDFYPFLKD
NREKIEKILTFRIPYYVGPLARGNSRFAWMTRKSEETITPWNFEEVVDKGASAQSFIERMTN
FDKNLPNEKVLPKHSLLYEYFTVYNELTKVKYVTEGMRKPAFLSGEQKKAIVDLLFKTNRKV
TVKQLKEDYFKKIECFDSVEISGVEDRFNASLGTYHDLLKIIKDKDFLDNEENEDILEDIVL
TLTLFEDREMIEERLKTYAHLFDDKVMKQLKRRRYTGWGRLSRKLINGIRDKQSGKTILDFL

KSDGFANRNFMQLIHDDSLTFKEDIQKAQVSGQGDSLHEHIANLAGSPAIKKGILQTVKVVD
ELVKVMGRHKPENIVIEMARENQTTQKGQKNSRERMKRIEEGIKELGSQILKEHPVENTQLQ
NEKLYYLQNGRDMYVDQELDINRLSDYDVDAIVPQSFLKDDSIDNKVLTRSDKNRGKSDN
VPSEEVVKKMKNYWRQLLNAKLITQRKFDNLTKAERGGLSELDKAGFIKRQLVETRQITKHV
AQILDSRMNTKYDENDKLIREVKVITLKSKLVSDFRKDFQFYKVREINNYHHAHDAYLNAVV
GTALIKKYPKLESEFVYGDYKVYDVRKMIAKSEQEIGKATAKYFFYSNIMNFFKTEITLANG
EIRKRPLIETNGETGEIVWDKGRDFATVRKVLSMPQVNIVKKTEVQTGGFSKESILPKRNSD
KLIARKKDWDPKKYGGFDSPTVAYSVLVVAKVEKGKSKKLKSVKELLGITIMERSSFEKNPI
DFLEAKGYKEVKKDLIIKLPKYSLFELENGRKRMLASAGELQKGNELALPSKYVNFLYLASH
YEKLKGSPEDNEQKQLFVEQHKHYLDEIIEQISEFSKRVILADANLDKVLSAYNKHRDKPIR
EQAENIIHLFTLTNLGAPAAFKYFDTTIDRKRYTSTKEVLDATLIHQSITGLYETRIDLSQL
GGD*SGGSSGGSSGSETPGTSESATPESSGGSSGGS*KRNYILGLDIGITSVGYGIIDYETRDV
*IDAGVRLFKEANVENNEGRRSKRGARRLKRRRHRIQRVKKLLFDYNLLTDHSELSGINPYE
ARVKGLSQKLSEEEFSAALLHLAKRRGVHNVNEVEEDTGNELSTKEQISRNSKALEEKYVAE
LQLERLKKDGEVRGSINRFKTSDYVKEAKQLLKVQKAYHQLDQSFIDTYIDLLETRRTYYEG
PGEGSPFGWKDIKEWYEMLMGHCTYFPEELRSVKYAYNADLYNALNDLNNLVITRDENEKLE
YYEKFQIIENVFKQKKKPTLKQIAKEILVNEEDIKGYRVTSTGKPEFTNLKVYHDIKDITAR
KEIIENAELLDQIAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVVKRSFIQSIKVIN
AIIKKYGLPNDIIIELAREKNSKDAQKMINEMQKRNRQTNERIEEIIRTTGKENAKYLIEKI
KLHDMQEGKCLYSLEAIPLEDLLNNPFNYEVDHIIPRSVSFDNSFNNKVLVKQEEASKKGNR
TPFQYLSSSDSKISYETFKKHILNLAKGKGRISKTKKEYLLEERDINRFSVQKDFINRNLVD
TRYATRGLMNLLRSYFRVNNLDVKVKSINGGFTSFLRRKWKFKKERNKGYKHHAEDALIIAN
ADFIFKEWKKLDKAKKVMENQMFEEKQAESMPEIETEQEYKEIFITPHQIKHIKDFKDYKYS
HRVDKKPNRELINDTLYSTRKDDKGNTLIVNNLNGLYDKDNDKLKKLINKSPEKLLMYHHDP
QTYQKLKLIMEQYGDEKNPLYKYYEETGNYLTKYSKKDNGPVIKKIKYYGNKLNAHLDITDD
YPNSRNKVVKLSLKPYRFDVYLDNGVYKFVTVKNLDVIKKENYYEVNSKCYEEAKKLKKISN
QAEFIASFYNNDLIKINGELYRVIGVNNDLLNRIEVNMIDITYREYLENMNDKRPPRIIKTI
ASKTQSIKKYSTDILGNLYEVKSKKHPQIIKKG*MTNLSDIIEKETGKQLVIQESILMLPEEV
EEVIGNKPESDILVHTAYDESTDENVMLLTSDAPEYKPWALVIQDSNGENKIKMLEGADKRT
ADGSEFESPKKKRKV (SEQ ID NO: 130)*

In the above sequence, the plain text denotes a cytidine deaminase sequence (pmCDA), bold sequence indicates sequence derived from SpCas9 (nuclease inactive), the italics sequence denotes a linker sequence, the bold italic sequence denotes sequence derived from SaCas9 (nickase), the double underlined sequence denotes a UGI sequence, and the underlined sequence denotes a bipartite nuclear localization sequence.

NH2-[pmCDA]-[dSpCas9]-[nSaCas9-KKH]-UGI-NLS-COOH :

MTDAEYVRIHEKLDIYTFKKQFFNNKKSVSHRCYVLFELKRRGERRACFWGYAVNKPQSGTE
RGIHAEIFSIRKVEEYLRDNPGQFTINWYSSWSPCADCAEKILEWYNQELRGNGHTLKIWAC
KLYYEKNARNQIGLWNLRDNGVGLNVMVSEHYQCCRKIFIQSSHNQLNENRWLEKTLKRAEK
RRSELSIMIQVKILHTTKSPAV*SGGSSGGSSGSETPGTSESATPESSGGSSGGS*DKKYSIGL
AIGTNSVGWAVITDEYKVPSKKFKVLGNTDRHSIKKNLIGALLFDSGETAEATRLKRTARRR
YTRRKNRICYLQEIFSNEMAKVDDSFFHRLEESFLVEEDKKHERHPIFGNIVDEVAYHEKYP
TIYHLRKKLVDSTDKADLRLIYLALAHMIKFRGHFLIEGDLNPDNSDVDKLFIQLVQTYNQL
FEENPINASGVDAKAILSARLSKSRRLENLIAQLPGEKKNGLFGNLIALSLGLTPNFKSNFD
LAEDAKLQLSKDTYDDDLDNLLAQIGDQYADLFLAAKNLSDAILLSDILRVNTEITKAPLSA
SMIKRYDEHHQDLTLLKALVRQQLPEKYKEIFFDQSKNGYAGYIDGGASQEEFYKFIKPILE
KMDGTEELLVKLNREDLLRKQRTFDNGSIPHQIHLGELHAILRRQEDFYPFLKDNREKIEKI
LTFRIPYYVGPLARGNSRFAWMTRKSEETITPWNFEEVVDKGASAQSFIERMTNFDKNLPNE
KVLPKHSLLYEYFTVYNELTKVKYVTEGMRKPAFLSGEQKKAIVDLLFKTNRKVTVKQLKED
YFKKIECFDSVEISGVEDRFNASLGTYHDLLKIIKDKDFLDNEENEDILEDIVLTLTLFEDR
EMIEERLKTYAHLFDDKVMKQLKRRRYTGWGRLSRKLINGIRDKQSGKTILDFLKSDGFANR
NFMQLIHDDSLTFKEDIQKAQVSGQGDSLHEHIANLAGSPAIKKGILQTVKVVDELVKVMGR
HKPENIVIEMARENQTTQKGQKNSRERMKRIEEGIKELGSQILKEHPVENTQLQNEKLYLYY
LQNGRDMYVDQELDINRLSDYDVDAIVPQSFLKDDSIDNKVLTRSDKNRGKSDNVPSEEVVK
KMKNYWRQLLNAKLITQRKFDNLTKAERGGLSELDKAGFIKRQLVETRQITKHVAQILDSRM
NTKYDENDKLIREVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEITLANGEIRKRPLI
ETNGETGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFLEAKGY
KEVKKDLIIKLPKYSLFELENGRKRMLASAGELQKGNELALPSKYVNFLYLASHYEKLKGSP
EDNEQKQLFVEQHKHYLDEIIEQISEFSKRVILADANLDKVLSAYNKHRDKPIREQAENIIH
LFTLTNLGAPAAFKYFDTTIDRKRYTSTKEVLDATLIHQSITGLYETRIDLSQLGGD*SGGSS
GGSSGSETPGTSESATPESSGGSSGGS*KRNYILGLDIGITSVGYGIIDYETRDVIDAGVRLF
KEANVENNEGRRSKRGARRLKRRRRHRIQRVKKLLFDYNLLTDHSELSGINPYEARVKGLSQ
KLSEEEFSAALLHLAKRRGVHNVNEVEEDTGNELSTKEQISRNSKALEEKYVAELQLERLKK
DGEVRGSINRFKTSDYVKEAKQLLKVQKAYHQLDQSFIDTYIDLLETRRTYYEGPGEGSPFG

*WKDIKEWYEMLMGHCTYFPEELRSVKYAYNADLYNALNDLNNLVITRDENEKLEYYEKFQII
ENVFKQKKKPTLKQIAKEILVNEEDIKGYRVTSTGKPEFTNLKVYHDIKDITARKEIIENAE
LLDQIAKILTIYQSSEDIQEELTNLNSELTQEEIEQISNLKGYTGTHNLSLKAINLILDELW
HTNDNQIAIFNRLKLVPKKVDLSQQKEIPTTLVDDFILSPVVKRSFIQSIKVINAIIKKYGL
PNDIIIELAREKNSKDAQKMINEMQKRNRQTNERIEEIIRTTGKENAKYLIEKIKLHDMQEG
KCLYSLEAIPLEDLLNNPFNYEVDHIIPRSVSFDNSFNNKVLVKQEEASKKGNRTPFQYLSS
SDSKISYETFKKHILNLAKGKGRISKTKKEYLLEERDINRFSVQKDFINRNLVDTRYATRGL
MNLLRSYFRVNNLDVKVKSINGGFTSFLRRKWKFKKERNKGYKHHAEDALIIANADFIFKEW
KKLDKAKKVMENQMFEEKQAESMPEIETEQEYKEIFITPHQIKHIKDFKDYKYSHRVDKKPN
RKLINDTLYSTRKDDKGNTLIVNNLNGLYDKDNDKLKKLINKSPEKLLMYHHDPQTYQKLKL
IMEQYGDEKNPLYKYYEETGNYLTKYSKKDNGPVIKKIKYYGNKLNAHLDITDDYPNSRNKV
VKLSLKPYRFDVYLDNGVYKFVTVKNLDVIKKENYYEVNSKCYEEAKKLKKISNQAEFIASF
YKNDLIKINGELYRVIGVNNDLLNRIEVNMIDITYREYLENMNDKRPPHIIKTIASKTQSIK
KYSTDILGNLYEVKSKKHPQIIKKG*<u>MTNLSDIIEKETGKQLVIQESILMLPEEVEEVIGNKP
ESDILVHTAYDESTDENVMLLTSDAPEYKPWALVIQDSNGENKIKMLEGADKRTADGSEFES
PKKKRKV</u> (SEQ ID NO: 131)

In the above sequence, the plain text denotes a cytidine deaminase sequence (pmCDA), bold sequence indicates sequence derived from SpCas9 (nuclease inactive), the italics sequence denotes a linker sequence, the bold italic sequence denotes sequence derived from SaCas9 (nickase with KKH mutations), the double underlined sequence denotes a UGI sequence, and the underlined sequence denotes a bipartite nuclear localization sequence.

NH2-[pmCDA]-[dSpCas9]-UGI-NLS-COOH:
MTDAEYVRIHEKLDIYTFKKQFFNNKKSVSHRCYVLFELKRRGERRACFWGYAVNKPQSGTE
RGIHAEIFSIRKVEEYLRDNPGQFTINWYSSWSPCADCAEKILEWYNQELRGNGHTLKIWAC
KLYYEKNARNQIGLWNLRDNGVGLNVMVSEHYQCCRKIFIQSSHNQLNENRWLEKTLKRAEK
RRSELSIMIQVKILHTTKSPAV*SGGSSGGSSGSETPGTSESATPESSGGSSGGS*DKKYSIGL
AIGTNSVGWAVITDEYKVPSKKFKVLGNTDRHSIKKNLIGALLFDSGETAEATRLKRTARRR
YTRRKNRICYLQEIFSNEMAKVDDSFFHRLEESFLVEEDKKHERHPIFGNIVDEVAYHEKYP
TIYHLRKKLVDSTDKADLRLIYLALAHMIKFRGHFLIEGDLNPDNSDVDKLFIQLVQTYNQL
FEENPINASGVDAKAILSARLSKSRRLENLIAQLPGEKKNGLFGNLIALSLGLTPNFKSNFD
LAEDAKLQLSKDTYDDDLDNLLAQIGDQYADLFLAAKNLSDAILLSDILRVNTEITKAPLSA
SMIKRYDEHHQDLTLLKALVRQQLPEKYKEIFFDQSKNGYAGYIDGGASQEEFYKFIKPILE
KMDGTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDKNLPNE
KVLPKHSLLYEYFTVYNELTKVKYVTEGMRKPAFLSGEQKKAIVDLLFKTNRKVTVKQLKED
YFKKIECFDSVEISGVEDRFNASLGTYHDLLKIIKDKDFLDNEENEDILEDIVLTLTLFEDR
EMIEERLKTYAHLFDDKVMKQLKRRRYTGWGRLSRKLINGIRDKQSGKTILDFLKSDGFANR
NFMQLIHDDSLTFKEDIQKAQVSGQGDSLHEHIANLAGSPAIKKGILQTVKVVDELVKVMGR
HKPENIVIEMARENQTTQKGQKNSRERMKRIEEGIKELGSQILKEHPVENTQLQNEKLYLYY
LQNGRDMYVDQELDINRLSDYDVDAIVPQSFLKDDSIDNKVLTRSDKNRGKSDNVPSEEVVK
KMKNYWRQLLNAKLITQRKFDNLTKAERGGLSELDKAGFIKRQLVETRQITKHVAQILDSRM
NTKYDENDKLIREVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEITLANGEIRKRPLI
ETNGETGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFLEAKGY
KEVKKDLIIKLPKYSLFELENGRKRMLASAGELQKGNELALPSKYVNFLYLASHYEKLKGSP
EDNEQKQLFVEQHKHYLDEIIEQISEFSKRVILADANLDKVLSAYNKHRDKPIREQAENIIH
LFTLTNLGAPAAFKYFDTTIDRKRYTSTKEVLDATLIHQSITGLYETRIDLSQLGGDMTNLS
DIIEKETGKQLVIQESILMLPEEVEEVIGNKPESDILVHTAYDESTDENVMLLTSDAPEYKP
WALVIQDSNGENKIKMLEGADKRTADGSEFESPKKKRKV (SEQ ID NO: 132)

In the above sequence, the plain text denotes a cytidine deaminase sequence (pmCDA), bold sequence indicates sequence derived from SpCas9 (nuclease inactive), the italics sequence denotes a linker sequence, the double underlined sequence denotes a UGI sequence, and the underlined sequence denotes a bipartite nuclear localization sequence.

NH2-[nSaCas9]-NLS-COOH

*KRNYILGLDIGITSVGYGIIDYETRDVIDAGVRLFKEANVENNEGRRSKRGARRLKRRRRHR
IQRVKKLLFDYNLLTDHSELSGINPYEARVKGLSQKLSEEEFSAALLHLAKRRGVHNVNEVE
EDTGNELSTKEQISRNSKALEEKYVAELQLERLKKDGEVRGSINRFKTSDYVKEAKQLLKVQ
KAYHQLDQSFIDTYIDLLETRRTYYEGPGEGSPFGWKDIKEWYEMLMGHCTYFPEELRSVKY
AYNADLYNALNDLNNLVITRDENEKLEYYEKFQIIENVFKQKKKPTLKQIAKEILVNEEDIK
GYRVTSTGKPEFTNLKVYHDIKDITARKEIIENAELLDQIAKILTIYQSSEDIQEELTNLNS
ELTQEEIEQISNLKGYTGTHNLSLKAINLILDELWHTNDNQIAIFNRLKLVPKKVDLSQQKE
IPTTLVDDFILSPVVKRSFIQSIKVINAIIKKYGLPNDIIIELAREKNSKDAQKMINEMQKR
NRQTNERIEEIIRTTGKENAKYLIEKIKLHDMQEGKCLYSLEAIPLEDLLNNPFNYEVDHII
PRSVSFDNSFNNKVLVKQEEASKKGNRTPFQYLSSSDSKISYETFKKHILNLAKGKGRISKT
KKEYLLEERDINRFSVQKDFINRNLVDTRYATRGLMNLLRSYFRVNNLDVKVKSINGGFTSF*

*LRRKWKFKKERNKGYKHHAEDALIIANADFIFKEWKKLDKAKKVMENQMFEEKQAESMPEIE*
*TEQEYKEIFITPHQIKHIKDFKDYKYSHRVDKKPNRELINDTLYSTRKDDKGNTLIVNNLNG*
*LYDKDNDKLKKLINKSPEKLLMYHHDPQTYQKLKLIMEQYGDEKNPLYKYYEETGNYLTKYS*
*KKDNGPVIKKIKYYGNKLNAHLDITDDYPNSRNKVVKLSLKPYRFDVYLDNGVYKFVTVKNL*
*DVIKKENYYEVNSKCYEEAKKLKKISNQAEFIASFYNNDLIKINGELYRVIGVNNDLLNRIE*
*VNMIDITYREYLENMNDKRPPRIIKTIASKTQSIKKYSTDILGNLYEVKSKKHPQIIKKG*<u>EG</u>
<u>ADKRTADGSEFESPKKKRKV</u> (SEQ ID NO: 133)

In the above sequence, the bold italic sequence denotes sequence derived from SaCas9 (nickase with KKH mutations), and the underlined sequence denotes a bipartite nuclear localization sequence.

NH2-[nSaCas9-KKH]-NLS-COOH (N579A)

*KRNYILGLDIGITSVGYGIIDYETRDVIDAGVRLFKEANVENNEGRRSKRGARRLKRRRRHR*
*IQRVKKLLFDYNLLTDHSELSGINPYEARVKGLSQKLSEEEFSAALLHLAKRRGVHNVNEVE*
*EDTGNELSTKEQISRNSKALEEKYVAELQLERLKKDGEVRGSINRFKTSDYVKEAKQLLKVQ*
*KAYHQLDQSFIDTYIDLLETRRTYYEGPGEGSPFGWKDIKEWYEMLMGHCTYFPEELRSVKY*
*AYNADLYNALNDLNNLVITRDENEKLEYYEKFQIIENVFKQKKKPTLKQIAKEILVNEEDIK*
*GYRVTSTGKPEFTNLKVYHDIKDITARKEIIENAELLDQIAKILTIYQSSEDIQEELTNLNS*
*ELTQEEIEQISNLKGYTGTHNLSLKAINLILDELWHTNDNQIAIFNRLKLVPKKVDLSQQKE*
*IPTTLVDDFILSPVVKRSFIQSIKVINAIIKKYGLPNDIIIELAREKNSKDAQKMINEMQKR*
*NRQTNERIEEIIRTTGKENAKYLIEKIKLHDMQEGKCLYSLEAIPLEDLLNNPFNYEVDHII*
*PRSVSFDNSFNNKVLVKQEEASKKGNRTPFQYLSSSDSKISYETFKKHILNLAKGKGRISKT*
*KKEYLLEERDINRFSVQKDFINRNLVDTRYATRGLMNLLRSYFRVNNLDVKVKSINGGFTSF*
*LRRKWKFKKERNKGYKHHAEDALIIANADFIFKEWKKLDKAKKVMENQMFEEKQAESMPEIE*
*TEQEYKEIFITPHQIKHIKDFKDYKYSHRVDKKPNRKLINDTLYSTRKDDKGNTLIVNNLNG*
*LYDKDNDKLKKLINKSPEKLLMYHHDPQTYQKLKLIMEQYGDEKNPLYKYYEETGNYLTKYS*
*KKDNGPVIKKIKYYGNKLNAHLDITDDYPNSRNKVVKLSLKPYRFDVYLDNGVYKFVTVKNL*
*DVIKKENYYEVNSKCYEEAKKLKKISNQAEFIASFYKNDLIKINGELYRVIGVNNDLLNRIE*
*VNMIDITYREYLENMNDKRPPHIIKTIASKTQSIKKYSTDILGNLYEVKSKKHPQIIKKG*<u>EG</u>
<u>ADKRTADGSEFESPKKKRKV</u> (SEQ ID NO: 134)

In the above sequence, the bold italic sequence denotes sequence derived from SaCas9 (nickase with KKH mutations), and the underlined sequence denotes a bipartite nuclear localization sequence.

NH2-[nSaCas9-KKH]-NLS-COOH (D9A)

*KRNYILGLAIGITSVGYGIIDYETRDVIDAGVRLFKEANVENNEGRRSKRGARRLKRRRRHR*
*IQRVKKLLFDYNLLTDHSELSGINPYEARVKGLSQKLSEEEFSAALLHLAKRRGVHNVNEVE*
*EDTGNELSTKEQISRNSKALEEKYVAELQLERLKKDGEVRGSINRFKTSDYVKEAKQLLKVQ*
*KAYHQLDQSFIDTYIDLLETRRTYYEGPGEGSPFGWKDIKEWYEMLMGHCTYFPEELRSVKY*
*AYNADLYNALNDLNNLVITRDENEKLEYYEKFQIIENVFKQKKKPTLKQIAKEILVNEEDIK*
*GYRVTSTGKPEFTNLKVYHDIKDITARKEIIENAELLDQIAKILTIYQSSEDIQEELTNLNS*
*ELTQEEIEQISNLKGYTGTHNLSLKAINLILDELWHTNDNQIAIFNRLKLVPKKVDLSQQKE*
*IPTTLVDDFILSPVVKRSFIQSIKVINAIIKKYGLPNDIIIELAREKNSKDAQKMINEMQKR*
*NRQTNERIEEIIRTTGKENAKYLIEKIKLHDMQEGKCLYSLEAIPLEDLLNNPFNYEVDHII*
*PRSVSFDNSFNNKVLVKQEENSKKGNRTPFQYLSSSDSKISYETFKKHILNLAKGKGRISKT*
*KKEYLLEERDINRFSVQKDFINRNLVDTRYATRGLMNLLRSYFRVNNLDVKVKSINGGFTSF*
*LRRKWKFKKERNKGYKHHAEDALIIANADFIFKEWKKLDKAKKVMENQMFEEKQAESMPEIE*
*TEQEYKEIFITPHQIKHIKDFKDYKYSHRVDKKPNRKLINDTLYSTRKDDKGNTLIVNNLNG*
*LYDKDNDKLKKLINKSPEKLLMYHHDPQTYQKLKLIMEQYGDEKNPLYKYYEETGNYLTKYS*
*KKDNGPVIKKIKYYGNKLNAHLDITDDYPNSRNKVVKLSLKPYRFDVYLDNGVYKFVTVKNL*
*DVIKKENYYEVNSKCYEEAKKLKKISNQAEFIASFYKNDLIKINGELYRVIGVNNDLLNRIE*
*VNMIDITYREYLENMNDKRPPHIIKTIASKTQSIKKYSTDILGNLYEVKSKKHPQIIKK*<u>GEG
ADKRTADGSEFESPKKKRKV</u> (SEQ ID NO: 135)

In the above sequence, the bold italic sequence denotes sequence derived from SaCas9 (nickase with KKH mutations), and the underlined sequence denotes a bipartite nuclear localization sequence.

NH2-[pmCDA]-[dSaCas9]-UGI-[nSpCas9]-NLS-COOH :

MTDAEYVRIHEKLDIYTFKKQFFNNKKSVSHRCYVLFELKRRGERRACFWGYAVNKPQSG
TERGIHAEIFSIRKVEEYLRDNPGQFTINWYSSWSPCADCAEKILEWYNQELRGNGHTLK
IWACKLYYEKNARNQIGLWNLRDNGVGLNVMVSEHYQCCRKIFIQSSHNQLNENRWLEKT
LKRAEKRRSELSIMIQVKILHTTKSPAV*SGGSSGGSSGSETPGTSESATPESSGGSSGGS*
*KRNYILGLAIGITSVGYGIIDYETRDVIDAGVRLFKEANVENNEGRRSKRGARRLKRRRRHR*
*IQRVKKLLFDYNLLTDHSELSGINPYEARVKGLSQKLSEEEFSAALLHLAKRRGVHNVNEVE*
*EDTGNELSTKEQISRNSKALEEKYVAELQLERLKKDGEVRGSINRFKTSDYVKEAKQLLKVQ*
*KAYHQLDQSFIDTYIDLLETRRTYYEGPGEGSPFGWKDIKEWYEMLMGHCTYFPEELRSVKY*
*AYNADLYNALNDLNNLVITRDENEKLEYYEKFQIIENVFKQKKKPTLKQIAKEILVNEEDIK*
*GYRVTSTGKPEFTNLKVYHDIKDITARKEIIENAELLDQIAKILTIYQSSEDIQEELTNLNS*

ELTQEEIEQISNLKGYTGTHNLSLKAINLILDELWHTNDNQIAIFNRLKLVPKKVDLSQQKE
IPTTLVDDFILSPVVKRSFIQSIKVINAIIKKYGLPNDIIIELAREKNSKDAQKMINEMQKR
NRQTNERIEEIIRTTGKENAKYLIEKIKLHDMQEGKCLYSLEAIPLEDLLNNPFNYEVDHII
PRSVSFDNSFNNKVLVKQEEASKKGNRTPFQYLSSSDSKISYETFKKHILNLAKGKGRISKT
KKEYLLEERDINRFSVQKDFINRNLVDTRYATRGLMNLLRSYFRVNNLDVKVKSINGGFTSF
LRRKWKFKKERNKGYKHHAEDALIIANADFIFKEWKKLDKAKKVMENQMFEEKQAESMPEIE
TEQEYKEIFITPHQIKHIKDFKDYKYSHRVDKKPNRELINDTLYSTRKDDKGNTLIVNNLNG
LYDKDNDKLKKLINKSPEKLLMYHHDPQTYQKLKLIMEQYGDEKNPLYKYYEETGNYLTKYS
KKDNGPVIKKIKYYGNKLNAHLDITDDYPNSRNKVVKLSLKPYRFDVYLDNGVYKFVTVKNL
DVIKKENYYEVNSKCYEEAKKLKKISNQAEFIASFYNNDLIKINGELYRVIGVNNDLLNRIE
VNMIDITYREYLENMNDKRPPRIIKTIASKTQSIKKYSTDILGNLYEVKSKKHPQIIKKG*SG
GSSGGSSGSETPGTSESATPESSGGSSGGS*MTNLSDIIEKETGKQLVIQESILMLPEEVEEV
IGNKPESDILVHTAYDESTDENVMLLTSDAPEYKPWALVIQDSNGENKIKML*SGGSSGGSSG
SETPGTSESATPESSGGSSGGS*DKKYSIGLAIGTNSVGWAVITDEYKVPSKKFKVLGNTDRH
SIKKNLIGALLFDSGETAEATRLKRTARRRYTRRKNRICYLQEIFSNEMAKVDDSFFHRLEE
SFLVEEDKKHERHPIFGNIVDEVAYHEKYPTIYHLRKKLVDSTDKADLRLIYLALAHMIKFR
GHFLIEGDLNPDNSDVDKLFIQLVQTYNQLFEENPINASGVDAKAILSARLSKSRRLENLIA
QLPGEKKNGLFGNLIALSLGLTPNFKSNFDLAEDAKLQLSKDTYDDDLDNLLAQIGDQYADL
FLAAKNLSDAILLSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRKQRTFDNGSIPHQ
IHLGELHAILRRQEDFYPFLKDNREKIEKILTFRIPYYVGPLARGNSRFAWMTRKSEETITP
WNFEEVVDKGASAQSFIERMTNFDKNLPNEKVLPKHSLLYEYFTVYNELTKVKYVTEGMRKP
AFLSGEQKKAIVDLLFKTNRKVTVKQLKEDYFKKIECFDSVEISGVEDRFNASLGTYHDLLK
IIKDKDFLDNEENEDILEDIVLTLTLFEDREMIEERLKTYAHLFDDKVMKQLKRRRYTGWGR
LSRKLINGIRDKQSGKTILDFLKSDGFANRNFMQLIHDDSLTFKEDIQKAQVSGQGDSLHEH
IANLAGSPAIKKGILQTVKVVDELVKVMGRHKPENIVIEMARENQTTQKGQKNSRERMKRIE
EGIKELGSQILKEHPVENTQLQNEKLYLYYLQNGRDMYVDQELDINRLSDYDVDHIVPQSFL
KDDSIDNKVLTRSDKNRGKSDNVPSEEVVKKMKNYWRQLLNAKLITQRKFDNLTKAERGGLS
ELDKAGFIKRQLVETRQITKHVAQILDSRMNTKYDENDKLIREVKVITLKSKLVSDFRKDFQ
FYKVREINNYHHAHDAYLNAVVGTALIKKYPKLESEFVYGDYKVYDVRKMIAKSEQEIGKAT
AKYFFYSNIMNFFKTEITLANGEIRKRPLIETNGETGEIVWDKGRDFATVRKVLSMPQVNIV
KKTEVQTGGFSKESILPKRNSDKLIARKKDWDPKKYGGFDSPTVAYSVLVVAKVEKGKSKKL
KSVKELLGITIMERSSFEKNPIDFLEAKGYKEVKKDLIIKLPKYSLFELENGRKRMLASAGE
LQKGNELALPSKYVNFLYLASHYEKLKGSPEDNEQKQLFVEQHKHYLDEIIEQISEFSKRVI

*LADANLDKVLSAYNKHRDKPIREQAENIIHLFTLTNLGAPAAFKYFDTTIDRKRYTSTKEVL*

*DATLIHQSITGLYETRIDLSQLGGD*<u>EGADKRTADGSEFESPKKKRKV</u> (SEQ ID NO: 136)

In the above sequence, the plain text denotes a cytidine deaminase sequence (pmCDA), bold sequence indicates sequence derived from SaCas9 (nuclease inactive), the italics sequence denotes a linker sequence, the bold italic sequence denotes sequence derived from SpCas9 (nickase-D10A), the double underlined sequence denotes a UGI sequence, and the underlined sequence denotes a bipartite nuclear localization sequence.

NH$_2$-[pmCDA]-[dSaCas9]-UGI-[nSpCas9]-NLS-COOH :

MTDAEYVRIHEKLDIYTFKKQFFNNKKSVSHRCYVLFELKRRGERRACFWGYAVNKPQSG
TERGIHAEIFSIRKVEEYLRDNPGQFTINWYSSWSPCADCAEKILEWYNQELRGNGHTLK
IWACKLYYEKNARNQIGLWNLRDNGVGLNVMVSEHYQCCRKIFIQSSHNQLNENRWLEKT
LKRAEKRRSELSIMIQVKILHTTKSPAV*SGGSSGGSSGSETPGTSESATPESSGGSSGGS*
**KRNYILGLAIGITSVGYGIIDYETRDVIDAGVRLFKEANVENNEGRRSKRGARRLKRRRRHR
IQRVKKLLFDYNLLTDHSELSGINPYEARVKGLSQKLSEEEFSAALLHLAKRRGVHNVNEVE
EDTGNELSTKEQISRNSKALEEKYVAELQLERLKKDGEVRGSINRFKTSDYVKEAKQLLKVQ
KAYHQLDQSFIDTYIDLLETRRTYYEGPGEGSPFGWKDIKEWYEMLMGHCTYFPEELRSVKY
AYNADLYNALNDLNNLVITRDENEKLEYYEKFQIIENVFKQKKKPTLKQIAKEILVNEEDIK
GYRVTSTGKPEFTNLKVYHDIKDITARKEIIENAELLDQIAKILTIYQSSEDIQEELTNLNS
ELTQEEIEQISNLKGYTGTHNLSLKAINLILDELWHTNDNQIAIFNRLKLVPKKVDLSQQKE
IPTTLVDDFILSPVVKRSFIQSIKVINAIIKKYGLPNDIIIELAREKNSKDAQKMINEMQKR
NRQTNERIEEIIRTTGKENAKYLIEKIKLHDMQEGKCLYSLEAIPLEDLLNNPFNYEVDHII
PRSVSFDNSFNNKVLVKQEEASKKGNRTPFQYLSSSDSKISYETFKKHILNLAKGKGRISKT
KKEYLLEERDINRFSVQKDFINRNLVDTRYATRGLMNLLRSYFRVNNLDVKVKSINGGFTSF
LRRKWKFKKERNKGYKHHAEDALIIANADFIFKEWKKLDKAKKVMENQMFEEKQAESMPEIE
TEQEYKEIFITPHQIKHIKDFKDYKYSHRVDKKPNRELINDTLYSTRKDDKGNTLIVNNLNG
LYDKDNDKLKKLINKSPEKLLMYHHDPQTYQKLKLIMEQYGDEKNPLYKYYEETGNYLTKYS
KKDNGPVIKKIKYYGNKLNAHLDITDDYPNSRNKVVKLSLKPYRFDVYLDNGVYKFVTVKNL
DVIKKENYYEVNSKCYEEAKKLKKISNQAEFIASFYNNDLIKINGELYRVIGVNNDLLNRIE
VNMIDITYREYLENMNDKRPPRIIKTIASKTQSIKKYSTDILGNLYEVKSKKHPQIIKKG***SG
GSSGGSSGSETPGTSESATPESSGGSSGGS*<u>MTNLSDIIEKETGKQLVIQESILMLPEEVEEV
IGNKPESDILVHTAYDESTDENVMLLTSDAPEYKPWALVIQDSNGENKIKML</u>*SGGSSGGSSG
SETPGTSESATPESSGGSSGGS*DKKYSIGLDIGTNSVGWAVITDEYKVPSKKFKVLGNTDRH

*SIKKNLIGALLFDSGETAEATRLKRTARRRYTRRKNRICYLQEIFSNEMAKVDDSFFHRLEE*
*SFLVEEDKKHERHPIFGNIVDEVAYHEKYPTIYHLRKKLVDSTDKADLRLIYLALAHMIKFR*
*GHFLIEGDLNPDNSDVDKLFIQLVQTYNQLFEENPINASGVDAKAILSARLSKSRRLENLIA*
*QLPGEKKNGLFGNLIALSLGLTPNFKSNFDLAEDAKLQLSKDTYDDDLDNLLAQIGDQYADL*
*FLAAKNLSDAILLSDILRVNTEITKAPLSASMIKRYDEHHQDLTLLKALVRQQLPEKYKEIF*
*FDQSKNGYAGYIDGGASQEEFYKFIKPILEKMDGTEELLVKLNREDLLRKQRTFDNGSIPHQ*
*IHLGELHAILRRQEDFYPFLKDNREKIEKILTFRIPYYVGPLARGNSRFAWMTRKSEETITP*
*WNFEEVVDKGASAQSFIERMTNFDKNLPNEKVLPKHSLLYEYFTVYNELTKVKYVTEGMRKP*
*AFLSGEQKKAIVDLLFKTNRKVTVKQLKEDYFKKIECFDSVEISGVEDRFNASLGTYHDLLK*
*IIKDKDFLDNEENEDILEDIVLTLTLFEDREMIEERLKTYAHLFDDKVMKQLKRRRYTGWGR*
*LSRKLINGIRDKQSGKTILDFLKSDGFANRNFMQLIHDDSLTFKEDIQKAQVSGQGDSLHEH*
*IANLAGSPAIKKGILQTVKVVDELVKVMGRHKPENIVIEMARENQTTQKGQKNSRERMKRIE*
*EGIKELGSQILKEHPVENTQLQNEKLYLYYLQNGRDMYVDQELDINRLSDYDVDAIVPQSFL*
*KDDSIDNKVLTRSDKNRGKSDNVPSEEVVKKMKNYWRQLLNAKLITQRKFDNLTKAERGGLS*
*ELDKAGFIKRQLVETRQITKHVAQILDSRMNTKYDENDKLIREVKVITLKSKLVSDFRKDFQ*
*FYKVREINNYHHAHDAYLNAVVGTALIKKYPKLESEFVYGDYKVYDVRKMIAKSEQEIGKAT*
*AKYFFYSNIMNFFKTEITLANGEIRKRPLIETNGETGEIVWDKGRDFATVRKVLSMPQVNIV*
*KKTEVQTGGFSKESILPKRNSDKLIARKKDWDPKKYGGFDSPTVAYSVLVVAKVEKGKSKKL*
*KSVKELLGITIMERSSFEKNPIDFLEAKGYKEVKKDLIIKLPKYSLFELENGRKRMLASAGE*
*LQKGNELALPSKYVNFLYLASHYEKLKGSPEDNEQKQLFVEQHKHYLDEIIEQISEFSKRVI*
*LADANLDKVLSAYNKHRDKPIREQAENIIHLFTLTNLGAPAAFKYFDTTIDRKRYTSTKEVL*
*DATLIHQSITGLYETRIDLSQLGG*<u>DEGADKRTADGSEFESPKKKRKV</u> (SEQ ID NO: 137)

In the above sequence, the plain text denotes a cytidine deaminase sequence (pmCDA), bold sequence indicates sequence derived from SaCas9 (nuclease inactive), the italics sequence denotes a linker sequence, the bold italic sequence denotes sequence derived from SpCas9 (nickase-H840A), the double underlined sequence denotes a UGI sequence, and the underlined sequence denotes a bipartite nuclear localization sequence.

NH2-[TadA]-[dSpCas9]-[nSaCas9]-COOH :

MSEVEFSHEYWMRHALTLAKRARDEREVPVGAVLVLNNRVIGEGWNRAIGLHDPTAHAEIMA
LRQGGLVMQNYRLIDATLYVTFEPCVMCAGAMIHSRIGRVVFGVRNAKTGAAGSLMDVLHYP
GMNHRVEITEGILADECAALLCYFFRMPRQVFNAQKKAQSSTD*SGGSSGGSSGSETPGTSES*
*ATPESSGGSSGGS*DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMIKFRGHFLIEGDL
NPDNSDVDKLFIQLVQTYNQLFEENPINASGVDAKAILSARLSKSRRLENLIAQLPGEKKNG
LFGNLIALSLGLTPNFKSNFDLAEDAKLQLSKDTYDDDLDNLLAQIGDQYADLFLAAKNLSD
AILLSDILRVNTEITKAPLSASMIKRYDEHHQDLTLLKALVRQQLPEKYKEIFFDQSKNGYA
GYIDGGASQEEFYKFIKPILEKMDGTEELLVKLNREDLLRKQRTFDNGSIPHQIHLGELHAI
LRRQEDFYPFLKDNREKIEKILTFRIPYYVGPLARGNSRFAWMTRKSEETITPWNFEEVVDK
GASAQSFIERMTNFDKNLPNEKVLPKHSLLYEYFTVYNELTKVKYVTEGMRKPAFLSGEQKK
AIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMKRIEEGIKELGSQ
ILKEHPVENTQLQNEKLYLYYLQNGRDMYVDQELDINRLSDYDVDAIVPQSFLKDDSIDNKV
LTRSDKNRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKVREINN
YHHAHDAYLNAVVGTALIKKYPKLESEFVYGDYKVYDVRKMIAKSEQ*SGGSSGGSSGSETPG*
*TSESATPESSGGSSGGS*KRNYILGLDIGITSVGYGIIDYETRDVIDAGVRLFKEANVENNEG
RRSKRGARRLKRRRRHRIQRVKKLLFDYNLLTDHSELSGINPYEARVKGLSQKLSEEEFSAA
LLHLAKRRGVHNVNEVEEDTGNELSTKEQISRNSKALEEKYVAELQLERLKKDGEVRGSINR
FKTSDYVKEAKQLLKVQKAYHQLDQSFIDTYIDLLETRRTYYEGPGEGSPFGWKDIKEWYEM
LMGHCTYFPEELRSVKYAYNADLYNALNDLNNLVITRDENEKLEYYEKFQIIENVFKQKKKP
TLKQIAKEILVNEEDIKGYRVTSTGKPEFTNLKVYHDIKDITARKEIIENAELLDQIAKILT
IYQSSEDIQEELTNLNSELTQEEIEQISNLKGYTGTHNLSLKAINLILDELWHTNDNQIAIF
NRLKLVPKKVDLSQQKEIPTTLVDDFILSPVVKRSFIQSIKVINAIIKKYGLPNDIIIELAR
EKNSKDAQKMINEMQKRNRQTNERIEEIIRTTGKENAKYLIEKIKLHDMQEGKCLYSLEAIP
LEDLLNNPFNYEVDHIIPRSVSFDNSFNNKVLVKQEEASKKGNRTPFQYLSSSDSKISYETF
KKHILNLAKGKGRISKTKKEYLLEERDINRFSVQKDFINRNLVDTRYATRGLMNLLRSYFRV
NNLDVKVKSINGGFTSFLRRKWKFKKERNKGYKHHAEDALIIANADFIFKEWKKLDKAKKVM
ENQMFEEKQAESMPEIETEQEYKEIFITPHQIKHIKDFKDYKYSHRVDKKPNRELINDTLYS
TRKDDKGNTLIVNNLNGLYDKDNDKLKKLINKSPEKLLMYHHDPQTYQKLKLIMEQYGDEKN
PLYKYYEETGNYLTKYSKKDNGPVIKKIKYYGNKLNAHLDITDDYPNSRNKVVKLSLKPYRF
DVYLDNGVYKFVTVKNLDVIKKENYYEVNSKCYEEAKKLKKISNQAEFIASFYNNDLIKING
ELYRVIGVNNDLLNRIEVNMIDITYREYLENMNDKRPPRIIKTIASKTQSIKKYSTDILGNL
YEVKSKKHPQIIKK*G<u>EGADKRTADGSEFESPKKKRKV</u>\** (SEQ ID NO: 138)

In the above sequence, the plain text denotes an adenosine deaminase sequence (TadA*7.10), bold sequence indicates sequence derived from SpCas9 (nuclease inactive), the italics sequence denotes a linker sequence, the bold italics sequence indicates sequence derived from SaCas9 (nickase), and the underlined sequence denotes a bipartite nuclear localization sequence.

NH2-[TadA]-[dSpCas9]-[nSaCas9-KKH]-COOH

MSEVEFSHEYWMRHALTLAKRARDEREVPVGAVLVLNNRVIGEGWNRAIGLHDPTAHAEIMA
LRQGGLVMQNYRLIDATLYVTFEPCVMCAGAMIHSRIGRVVFGVRNAKTGAAGSLMDVLHYP
GMNHRVEITEGILADECAALLCYFFRMPRQVFNAQKKAQSSTD*SGGSSGGSSGSETPGTSES*
*ATPESSGGSSGGS*DKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMIKFRGHFLIEGDL
NPDNSDVDKLFIQLVQTYNQLFEENPINASGVDAKAILSARLSKSRRLENLIAQLPGEKKNG
LFGNLIALSLGLTPNFKSNFDLAEDAKLQLSKDTYDDDLDNLLAQIGDQYADLFLAAKNLSD
AILLSDILRVNTEITKAPLSASMIKRYDEHHQDLTLLKALVRQQLPEKYKEIFFDQSKNGYA
GYIDGGASQEEFYKFIKPILEKMDGTEELLVKLNREDLLRKQRTFDNGSIPHQIHLGELHAI
LRRQEDFYPFLKDNREKIEKILTFRIPYYVGPLARGNSRFAWMTRKSEETITPWNFEEVVDK
GASAQSFIERMTNFDKNLPNEKVLPKHSLLYEYFTVYNELTKVKYVTEGMRKPAFLSGEQKK
AIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMKRIEEGIKELGSQ
ILKEHPVENTQLQNEKLYLYYLQNGRDMYVDQELDINRLSDYDVDAIVPQSFLKDDSIDNKV
LTRSDKNRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKVREINN
YHHAHDAYLNAVVGTALIKKYPKLESEFVYGDYKVYDVRKMIAKSEQ*SGGSSGGSSGSETPG*
*TSESATPESSGGSSGGS**KRNYILGLDIGITSVGYGIIDYETRDVIDAGVRLFKEANVENNEG*
*RRSKRGARRLKRRRRHRIQRVKKLLFDYNLLTDHSELSGINPYEARVKGLSQKLSEEEFSAA*
*LLHLAKRRGVHNVNEVEEDTGNELSTKEQISRNSKALEEKYVAELQLERLKKDGEVRGSINR*
*FKTSDYVKEAKQLLKVQKAYHQLDQSFIDTYIDLLETRRTYYEGPGEGSPFGWKDIKEWYEM*
*LMGHCTYFPEELRSVKYAYNADLYNALNDLNNLVITRDENEKLEYYEKFQIIENVFKQKKKP*
*TLKQIAKEILVNEEDIKGYRVTSTGKPEFTNLKVYHDIKDITARKEIIENAELLDQIAKILT*
*IYQSSEDIQEELTNLNSELTQEEIEQISNLKGYTGTHNLSLKAINLILDELWHTNDNQIAIF*

*NRLKLVPKKVDLSQQKEIPTTLVDDFILSPVVKRSFIQSIKVINAIIKKYGLPNDIIIELAR*
*EKNSKDAQKMINEMQKRNRQTNERIEEIIRTTGKENAKYLIEKIKLHDMQEGKCLYSLEAIP*
*LEDLLNNPFNYEVDHIIPRSVSFDNSFNNKVLVKQEEASKKGNRTPFQYLSSSDSKISYETF*
*KKHILNLAKGKGRISKTKKEYLLEERDINRFSVQKDFINRNLVDTRYATRGLMNLLRSYFRV*
*NNLDVKVKSINGGFTSFLRRKWKFKKERNKGYKHHAEDALIIANADFIFKEWKKLDKAKKVM*
*ENQMFEEKQAESMPEIETEQEYKEIFITPHQIKHIKDFKDYKYSHRVDKKPNRKLINDTLYS*
*TRKDDKGNTLIVNNLNGLYDKDNDKLKKLINKSPEKLLMYHHDPQTYQKLKLIMEQYGDEKN*
*PLYKYYEETGNYLTKYSKKDNGPVIKKIKYYGNKLNAHLDITDDYPNSRNKVVKLSLKPYRF*
*DVYLDNGVYKFVTVKNLDVIKKENYYEVNSKCYEEAKKLKKISNQAEFIASFYKNDLIKING*
*ELYRVIGVNNDLLNRIEVNMIDITYREYLENMNDKRPPHIIKTIASKTQSIKKYSTDILGNL*
*YEVKSKKHPQIIKKG*<u>EGADKRTADGSEFESPKKKRKV</u>* (SEQ ID NO: 139)

In the above sequence, the plain text denotes an adenosine deaminase sequence (TadA*7.10), bold sequence indicates sequence derived from SpCas9 (nuclease inactive), the italics sequence denotes a linker sequence, the bold italics sequence indicates sequence derived from SaCas9 (nickase), and the underlined sequence denotes a bipartite nuclear localization sequence.

NH$_2$-[TadA]-[dSpCas9]-NLS-COOH :
MSEVEFSHEYWMRHALTLAKRARDEREVPVGAVLVLNNRVIGEGWNRAIGLHDPTAHAEIMA
LRQGGLVMQNYRLIDATLYVTFEPCVMCAGAMIHSRIGRVVFGVRNAKTGAAGSLMDVLHYP
GMNHRVEITEGILADECAALLCYFFRMPRQVFNAQKKAQSSTD*SGGSSGGSSGSETPGTSES*
*ATPESSGGSSGGS*DKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMIKFRGHFLIEGDL
NPDNSDVDKLFIQLVQTYNQLFEENPINASGVDAKAILSARLSKSRRLENLIAQLPGEKKNG
LFGNLIALSLGLTPNFKSNFDLAEDAKLQLSKDTYDDDLDNLLAQIGDQYADLFLAAKNLSD
AILLSDILRVNTEITKAPLSASMIKRYDEHHQDLTLLKALVRQQLPEKYKEIFFDQSKNGYA
GYIDGGASQEEFYKFIKPILEKMDGTEELLVKLNREDLLRKQRTFDNGSIPHQIHLGELHAI
LRRQEDFYPFLKDNREKIEKILTFRIPYYVGPLARGNSRFAWMTRKSEETITPWNFEEVVDK
GASAQSFIERMTNFDKNLPNEKVLPKHSLLYEYFTVYNELTKVKYVTEGMRKPAFLSGEQKK
AIVDLLFKTNRKVTVKQLKEDYFKKIECFDSVEISGVEDRFNASLGTYHDLLKIIKDKDFLD
NEENEDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANLAGSPA

IKKGILQTVKVVDELVKVMGRHKPENIVIEMARENQTTQKGQKNSRERMKRIEEGIKELGSQ
ILKEHPVENTQLQNEKLYLYYLQNGRDMYVDQELDINRLSDYDVDAIVPQSFLKDDSIDNKV
LTRSDKNRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKVREINN
YHHAHDAYLNAVVGTALIKKYPKLESEFVYGDYKVYDVRKMIAKSEQ<u>EGADKRTADGSEFES
PKKKRKV</u>* (SEQ ID NO: 140)

In the above sequence, the plain text denotes an adenosine deaminase sequence (TadA*7.10), bold sequence indicates sequence derived from SpCas9 (nuclease inactive), the italics sequence denotes a linker sequence, and the underlined sequence denotes a bipartite nuclear localization sequence.

NH$_2$-[TadA]-[dSpCas9]-[nSaCas9]-COOH :

<u>MSEVEFSHEYWMRHALTLAKRAWDEREVPVGAVLVHNNRVIGEGWNRPIGRHDPTAHAEIMA
LRQGGLVMQNYRLIDATLYVTLEPCVMCAGAMIHSRIGRVVFGARDAKTGAAGSLMDVLHHP
GMNHRVEITEGILADECAALLSDFFRMRRQEIKAQKKAQSSTD</u>SGGSSGGSSGSETPGTSES
ATPESSGGSSGGSSEVEFSHEYWMRHALTLAKRARDEREVPVGAVLVLNNRVIGEGWNRAIG
LHDPTAHAEIMALRQGGLVMQNYRLIDATLYVTFEPCVMCAGAMIHSRIGRVVFGVRNAKTG
AAGSLMDVLHYPGMNHRVEITEGILADECAALLCYFFRMPRQVFNAQKKAQSSTD*SGGSSGG
SSGSETPGTSESATPESSGGSSGGS*DKKYSIGLAIGTNSVGWAVITDEYKVPSKKFKVLGNT
DRHSIKKNLIGALLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAILSARLSKSRRLEN
LIAQLPGEKKNGLFGNLIALSLGLTPNFKSNFDLAEDAKLQLSKDTYDDDLDNLLAQIGDQY
ADLFLAAKNLSDAILLSDILRVNTEITKAPLSASMIKRYDEHHQDLTLLKALVRQQLPEKYK
EIFFDQSKNGYAGYIDGGASQEEFYKFIKPILEKMDGTEELLVKLNREDLLRKQRTFDNGSI
PHQIHLGELHAILRRQEDFYPFLKDNREKIEKILTFRIPYYVGPLARGNSRFAWMTRKSEET
ITPWNFEEVVDKGASAQSFIERMTNFDKNLPNEKVLPKHSLLYEYFTVYNELTKVKYVTEGM
RKPAFLSGEQKKAIVDLLFKTNRKVTVKQLKEDYFKKIECFDSVEISGVEDRFNASLGTYHD
LLKIIKDKDFLDNEENEDILEDIVLTLTLFEDREMIEERLKTYAHLFDDKVMKQLKRRRYTG
WGRLSRKLINGIRDKQSGKTILDFLKSDGFANRNFMQLIHDDSLTFKEDIQKAQVSGQGDSL
HEHIANLAGSPAIKKGILQTVKVVDELVKVMGRHKPENIVIEMARENQTTQKGQKNSRERMK
RIEEGIKELGSQILKEHPVENTQLQNEKLYLYYLQNGRDMYVDQELDINRLSDYDVDAIVPQ
SFLKDDSIDNKVLTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVITLKSKLVSDFRK

DFQFYKVREINNYHHAHDAYLNAVVGTALIKKYPKLESEFVYGDYKVYDVRKMIAKSEQ*SGG SSGGSSGSETPGTSESATPESSGGSSGGS*KRNYILGLDIGITSVGYGIIDYETRDVIDAGVR LFKEANVENNEGRRSKRGARRLKRRRRHRIQRVKKLLFDYNLLTDHSELSGINPYEARVKGL SQKLSEEEFSAALLHLAKRRGVHNVNEVEEDTGNELSTKEQISRNSKALEEKYVAELQLERL KKDGEVRGSINRFKTSDYVKEAKQLLKVQKAYHQLDQSFIDTYIDLLETRRTYYEGPGEGSP FGWKDIKEWYEMLMGHCTYFPEELRSVKYAYNADLYNALNDLNNLVITRDENEKLEYYEKFQ IIENVFKQKKKPTLKQIAKEILVNEEDIKGYRVTSTGKPEFTNLKVYHDIKDITARKEIIEN AELLDQIAKILTIYQSSEDIQEELTNLNSELTQEEIEQISNLKGYTGTHNLSLKAINLILDE LWHTNDNQIAIFNRLKLVPKKVDLSQQKEIPTTLVDDFILSPVVKRSFIQSIKVINAIIKKY GLPNDIIIELAREKNSKDAQKMINEMQKRNRQTNERIEEIIRTTGKENAKYLIEKIKLHDMQ EGKCLYSLEAIPLEDLLNNPFNYEVDHIIPRSVSFDNSFNNKVLVKQEEASKKGNRTPFQYL SSSDSKISYETFKKHILNLAKGKGRISKTKKEYLLEERDINRFSVQKDFINRNLVDTRYATR GLMNLLRSYFRVNNLDVKVKSINGGFTSFLRRKWKFKKERNKGYKHHAEDALIIANADFIFK EWKKLDKAKKVMENQMFEEKQAESMPEIETEQEYKEIFITPHQIKHIKDFKDYKYSHRVDKK PNRELINDTLYSTRKDDKGNTLIVNNLNGLYDKDNDKLKKLINKSPEKLLMYHHDPQTYQKL KLIMEQYGDEKNPLYKYYEETGNYLTKYSKKDNGPVIKKIKYYGNKLNAHLDITDDYPNSRN KVVKLSLKPYRFDVYLDNGVYKFVTVKNLDVIKKENYYEVNSKCYEEAKKLKKISNQAEFIA SFYNNDLIKINGELYRVIGVNNDLLNRIEVNMIDITYREYLENMNDKRPPRIIKTIASKTQS IKKYSTDILGNLYEVKSKKHPQIIKK<u>GEGADKRTADGSEFESPKKKRKV</u>* (SEQ ID NO: 141)

In the above sequence, the double underlined text denotes a wild type adenosine deaminase sequence (ecTadA), the plain text denotes an adenosine deaminase sequence (TadA*7.10), bold sequence indicates sequence derived from SpCas9 (nuclease inactive), the italics sequence denotes a linker sequence, the bold italics sequence indicates sequence derived from SaCas9 (nickase), and the underlined sequence denotes a bipartite nuclear localization sequence.

NH$_2$-[ecTadA]-[TadA*7.10]-[dSpCas9]-[nSaCas9-KKH]-COOH

<u>MSEVEFSHEYWMRHALTLAKRAWDEREVPVGAVLVHNNRVIGEGWNRPIGRHDPTAHAEIMA LRQGGLVMQNYRLIDATLYVTLEPCVMCAGAMIHSRIGRVVFGARDAKTGAAGSLMDVLHHP GMNHRVEITEGILADECAALLSDFFRMRRQEIKAQKKAQSSTD</u>*SGGSSGGSSGSETPGTSES ATPESSGGSSGGS*SEVEFSHEYWMRHALTLAKRARDEREVPVGAVLVLNNRVIGEGWNRAIG LHDPTAHAEIMALRQGGLVMQNYRLIDATLYVTFEPCVMCAGAMIHSRIGRVVFGVRNAKTG AAGSLMDVLHYPGMNHRVEITEGILADECAALLCYFFRMPRQVFNAQKKAQSSTD*SGGSSGG*

*SSGSETPGTSESATPESSGGSSGGS*DKKYSIGLAIGTNSVGWAVITDEYKVPSKKFKVLGNT
DRHSIKKNLIGALLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAILSARLSKSRRLEN
LIAQLPGEKKNGLFGNLIALSLGLTPNFKSNFDLAEDAKLQLSKDTYDDDLDNLLAQIGDQY
ADLFLAAKNLSDAILLSDILRVNTEITKAPLSASMIKRYDEHHQDLTLLKALVRQQLPEKYK
EIFFDQSKNGYAGYIDGGASQEEFYKFIKPILEKMDGTEELLVKLNREDLLRKQRTFDNGSI
PHQIHLGELHAILRRQEDFYPFLKDNREKIEKILTFRIPYYVGPLARGNSRFAWMTRKSEET
ITPWNFEEVVDKGASAQSFIERMTNFDKNLPNEKVLPKHSLLYEYFTVYNELTKVKYVTEGM
RKPAFLSGEQKKAIVDLLFKTNRKVTVKQLKEDYFKKIECFDSVEISGVEDRFNASLGTYHD
LLKIIKDKDFLDNEENEDILEDIVLTLTLFEDREMIEERLKTYAHLFDDKVMKQLKRRRYTG
WGRLSRKLINGIRDKQSGKTILDFLKSDGFANRNFMQLIHDDSLTFKEDIQKAQVSGQGDSL
HEHIANLAGSPAIKKGILQTVKVVDELVKVMGRHKPENIVIEMARENQTTQKGQKNSRERMK
RIEEGIKELGSQILKEHPVENTQLQNEKLYLYYLQNGRDMYVDQELDINRLSDYDVDAIVPQ
SFLKDDSIDNKVLTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVITLKSKLVSDFRK
DFQFYKVREINNYHHAHDAYLNAVVGTALIKKYPKLESEFVYGDYKVYDVRKMIAKSEQ*SGG
SSGGSSGSETPGTSESATPESSGGSSGGS*KRNYILGLDIGITSVGYGIIDYETRDVIDAGVR
LFKEANVENNEGRRSKRGARRLKRRRRHRIQRVKKLLFDYNLLTDHSELSGINPYEARVKGL
SQKLSEEEFSAALLHLAKRRGVHNVNEVEEDTGNELSTKEQISRNSKALEEKYVAELQLERL
KKDGEVRGSINRFKTSDYVKEAKQLLKVQKAYHQLDQSFIDTYIDLLETRRTYYEGPGEGSP
FGWKDIKEWYEMLMGHCTYFPEELRSVKYAYNADLYNALNDLNNLVITRDENEKLEYYEKFQ
IIENVFKQKKKPTLKQIAKEILVNEEDIKGYRVTSTGKPEFTNLKVYHDIKDITARKEIIEN
AELLDQIAKILTIYQSSEDIQEELTNLNSELTQEEIEQISNLKGYTGTHNLSLKAINLILDE
LWHTNDNQIAIFNRLKLVPKKVDLSQQKEIPTTLVDDFILSPVVKRSFIQSIKVINAIIKKY
GLPNDIIIELAREKNSKDAQKMINEMQKRNRQTNERIEEIIRTTGKENAKYLIEKIKLHDMQ
EGKCLYSLEAIPLEDLLNNPFNYEVDHIIPRSVSFDNSFNNKVLVKQEEASKKGNRTPFQYL
SSSDSKISYETFKKHILNLAKGKGRISKTKKEYLLEERDINRFSVQKDFINRNLVDTRYATR
GLMNLLRSYFRVNNLDVKVKSINGGFTSFLRRKWKFKKERNKGYKHHAEDALIIANADFIFK
EWKKLDKAKKVMENQMFEEKQAESMPEIETEQEYKEIFITPHQIKHIKDFKDYKYSHRVDKK
PNRKLINDTLYSTRKDDKGNTLIVNNLNGLYDKDNDKLKKLINKSPEKLLMYHHDPQTYQKL
KLIMEQYGDEKNPLYKYYEETGNYLTKYSKDNGPVIKKIKYYGNKLNAHLDITDDYPNSRN
KVVKLSLKPYRFDVYLDNGVYKFVTVKNLDVIKKENYYEVNSKCYEEAKKLKKISNQAEFIA
SFYKNDLIKINGELYRVIGVNNDLLNRIEVNMIDITYREYLENMNDKRPPHIIKTIASKTQS

*IKKYSTDILGNLYEVKSKKHPQIIKKG*EGADKRTADGSEFESPKKKRKV* (SEQ ID NO: 142)

In the above sequence, the double underlined text denotes a wild type TadA sequence (ecTadA), the plain text denotes an adenosine deaminase sequence (TadA*7.10), bold sequence indicates sequence derived from SpCas9 (nuclease inactive), the italics sequence denotes a linker sequence, the bold italics sequence indicates sequence derived from SaCas9 (nickase), and the underlined sequence denotes a bipartite nuclear localization sequence.

The feasibility of deaminating target sequences in double stranded DNA is demonstrated in FIG. 2, which illustrates the mechanism of target DNA binding of in vivo target sequences separately by dCas9:sgRNA1 and nCas9:sgRNA2.

Example 6: Nucleobase Editor Systems Containing dCas9-Cytidine Deaminase Linked to or Co-Expressed with nCas9 Reduces Indel Formation Plasmids harboring hCMV driven constructs and appropriate gRNAs are transfected into human embryonic kidney cells (HEK293T cells) that harbor the target DNA sequence, using a high efficiency low toxicity DNA tranfection reagent optimized for HEK293 cells, Mirus TransIT293. The plasmids harbor sequences that encode APOBEC1-dSpCas9-SaCas9n, or APOBEC1-dSpCas9 and SaCas9n in trans, first guide RNA (gRNA1) for SpCa9 recognition, and second guide RNA (gRNA2) for SaCas9 recognition. pmCDA-dSpCas9, pmCDA-nSaCas9, and pmCDA-nSaCa9-UGI plasmids are used as controls. All expression sequences are codon optimized.

A reporter system that can be used for testing deaminase activity of the fusion proteins described herein. The reporter system may be a luciferase-based or GFP-based assay in which deaminase activity leads to expression of luciferase or the GFP. In some embodiments, an intended target residue is be located in an ACG mutated start codon of the luciferase gene that is unable to initiate translation. Desired deaminase activity results in a ACG>August modification, thus enabling translation of luciferase and detection and quantification of the deaminase activity. To minimize the impact of potential substrate promiscuity of the deaminase domain (e.g., the AID domain), the number of residues that could unintentionally be targeted for deamination (e.g., off-target C residues that could potentially reside on ssDNA within the reporter system) is minimized. In some embodiments, in order to minimize single-stranded C residues, a leader sequence is inserted between the mutated start codon and the beginning of the luciferase gene which consists of a stretch of Lys (AAA), Asn (AAT), Leu (TTA), He (ATT, ATA), Tyr (TAT), or Phe (TTT) residues. The resulting mutants can be tested to ensure that the leader sequence does not adversely affect luciferase expression or activity. Background luciferase activity with the mutated start codon can be determined as well.

Once fusion proteins that are capable of programmable site-specific C to U modifications have been identified, their activities can be further characterized. The data from the luciferase assays can, for example, be integrated into heat maps that describe which nucleotides, with respect to the sgRNA target DNA, are being targeted for deamination by a specific fusion protein. In some embodiments, the position that results in the highest activity in the luciferase assay for each fusion is considered the "target" position, while all others are considered off-target positions. Additional reporter systems, e.g., variations of the exemplary systems described in detail above, are also embraced by this disclosure.

After four days for plasmid transfections and two days for RNA electroporation, genomic DNA is extracted from the cells with a simple lysis buffer of 0.05% SDS, 25 µg/ml proteinase K, 10 mM Tris pH 8.0, followed by a heat inactivation at 85° C. Genomic sites are PCR amplified and sequenced on a MiSeq. Both strands of the target sequence are sequenced to show base editing efficiency. Results are analyzed as previously described for base frequencies at each position and for percent indels. Details of indel calculations are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3: eaao4774 (2017), the entire contents of which are hereby incorporated by reference.

Example 7: Nucleobase Editor Systems Containing Dcas9-Adenosine Deaminase Linked to or Co-Expressed with Ncas9 Reduces Indel Formation Plasmids harboring hCMV driven constructs are transfected into human embryonic kidney cells (HEK293T cells) using a high efficiency low toxicity DNA tranfection reagent optimized for HEK293 cells, Mirus TransIT293. The plasmids harbor sequences that encode TadA7.10-dSpCas9-SaCas9n, or TadA7.10-dSpCas9 and SaCas9n in trans, first guide RNA (gRNA1) for dSpCa9 recognition, and second guide RNA (gRNA2) for SaCas9n recognition as illustrated in FIG. 1. TadA7.10-dSpCas9 and TadA7.10-SaCas9n plasmids are used as controls. All expression sequences are codon optimized. Exemplary gRNA1 for A-G conversion at ABCA4 5882A and gRNA2 for SaCas9n recognition are designed according to public tools cas-offinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014) and Hwang et al., Web-based design and analysis tools for CRISPR base editing. BMC Bioinfomatics 19, Article number: 542 (2018). After four days for plasmid transfections and two days for RNA electroporation, genomic DNA is extracted from the cells with a simple lysis buffer of 0.05% SDS, 25 µg/ml proteinase K, 10 mM Tris pH 8.0, followed by a heat inactivation at 85° C. Genomic sites are PCR amplified and sequenced on a MiSeq. Both strands of the target sequence are sequenced to show base editing efficiency. Results are analyzed as previously described for base frequencies at each position and for percent indels. Details of indel calculations are described in International PCT Application Nos. PCT/2017/045381 (WO2018/027078) and
PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to- T:A base editors with higher efficiency and product purity" Science Advances 3: eaao4774 (2017), the entire contents of which are hereby incorporated by reference. Exemplary guide sequences are shown below.

Example 8: Material and Methods

Results provided in the Examples described herein were obtained using the following materials and methods.
Cloning/Transfections.

PCR is performed using VeraSeq ULtra DNA polymerase (Enzymatics), or Q5 Hot Start High-Fidelity DNA Polymerase (New England Biolabs). Base Editor (BE) plasmids are constructed using USER cloning (New England Biolabs). Deaminase genes are synthesized as gBlocks Gene Fragments (Integrated DNA Technologies). Cas9 genes are obtained from previously reported plasmids. Deaminase and fusion genes are cloned into pCMV (mammalian codon-optimized) or pET28b (*E. coli* codon-optimized) backbones. sgRNA expression plasmids are constructed using site-directed mutagenesis. By way of example, the gRNA plasmid comprises an art-recognized U6 promoter driving the expression of the gRNA. For BE plasmids, e.g., an ABE plasmid, a CMV promoter is used to drive the expression of the base editor open reading frame.

Briefly, the primers are 5' phosphorylated using T4 Polynucleotide Kinase (New England Biolabs) according to the manufacturer's instructions. Next, PCR is performed using Q5 Hot Start High-Fidelity Polymerase (New England Biolabs) with the phosphorylated primers and the expression plasmid encoding the gene of interest, as a template according to the manufacturer's instructions. PCR products are incubated with DpnI (20 U, New England Biolabs) at 37° C. for 1 hour, purified on a QIAprep spin column (Qiagen), and ligated using QuickLigase (New England Biolabs) according to the manufacturer's instructions. DNA vector amplification was carried out using Mach1 competent cells (ThermoFisher Scientific).

This scaffold is used for the PAMs shown in the tables herein, e.g., NGG, NGA, NGC, NGT PAMs; the gRNA encompasses the scaffold sequence and the spacer sequence (target sequence) for disease-associated genes as provided herein or as determined based on the knowledge of the skilled practitioner and as would be understood to the skilled practitioner in the art. (See, e.g., Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3: eaao4774 (2017), and Rees, H. A., et al., "Base editing: precision chemistry on the genome and transcriptome of living cells." Nat Rev Genet. 2018 December; 19 (12): 770-788. doi: 10.1038/s41576-018-0059-1). For gRNAs, the following scaffold sequence is presented:

```
                                    (SEQ ID NO: 143)
         GUUUUAGAGCUAGAAAUAGCAAGUUAAAAUAA

GGCUAGUCCGUUAUCAACUUGAAAAAGU GGC

ACCGAGU CGGUGCUUUU
```

For all NNGRRT and NNNRRT PAMS the spacer plus the saCas9 scaffold has the following sequence:

```
                                    (SEQ ID NO: 144)
         GUUUUAGUACUCUGUAAUGAAAAUUACAGAAU

CUACUAAAACAAGGCAAAAUGCCGUGUUUAU

CUCGUCAACUUGUUGGCGAGAUUUUUU
```

In Vitro Deaminase Assay on ssDNA.

Sequences of all ssDNA substrates are provided below. All Cy3-labelled substrates are obtained from Integrated DNA Technologies (IDT). Deaminases are expressed in vitro using the TNT T7 Quick Coupled Transcription/Translation Kit (Promega) according to the manufacturer's instructions using 1 µg of plasmid. Following protein expression, 5 µl of lysate is combined with 35 µl of ssDNA (1.8 µM) and USER enzyme (1 unit) in CutSmart buffer (New England Biolabs) (50 mM potassium acetate, 29 mM Tris-acetate, 10 mM magnesium acetate, 100 µg ml-1 BSA, pH 7.9) and incubated at 37° C. for 2 h. Cleaved U-containing substrates are resolved from full-length unmodified substrates on a 10% TBE-urea gel (Bio-Rad).
Expression and Purification of BE-Linker-Binding Protein Fusions.

Competent cells, such as *E. coli* BL21 STAR (DE3)-competent cells (ThermoFisher Scientific), are transformed with plasmids encoding the fusion proteins as described herein, e.g. deaminase-dCas9-nCas9, deaminase-dCas9-nCas9-UGI, or deaminase-dCas9 and nCas9-UGI. The resulting expression strains are grown overnight in Luria-Bertani (LB) broth containing 100 µg ml-1 of kanamycin at 37° C. The cells are diluted 1:100 into the same growth medium and grown at 37° C. to OD600=~0.6. The culture is cooled to 4° C. over a period of 2 h, and isopropyl-β-d-1-thiogalactopyranoside (IPTG) is added at 0.5 mM to induce protein expression. After ~16 h, the cells are collected by centrifugation at 4,000 g and are resuspended in lysis buffer (50 mM tris(hydroxymethyl)-aminomethane (Tris)-HCl (pH 7.5), 1 M NaCl, 20% glycerol, 10 mM tris(2-carboxyethyl) phosphine (TCEP, Soltec Ventures)). The cells are lysed by sonication (20 s pulse-on, 20 s pulse-off for 8 min total at 6 W output) and the lysate supernatant is isolated following centrifugation at 25,000 g for 15 minutes. The lysate is incubated with His-Pur nickel-nitriloacetic acid (nickel-NTA) resin (ThermoFisher Scientific) at 4° C. for 1 hour to capture the His-tagged fusion protein. The resin is transferred to a column and is washed with 40 ml of lysis buffer. The His-tagged fusion protein is eluted in lysis buffer supplemented with 285 mM imidazole, and concentrated by ultrafiltration (Amicon-Millipore, 100-kDa molecular weight cut-off) to 1 ml total volume. The protein is diluted to 20 ml in low-salt purification buffer containing 50 mM tris(hydroxymethyl)-aminomethane (Tris)-HCl (pH 7.0), 0.1 M NaCl, 20% glycerol, 10 mM TCEP and loaded onto SP Sepharose Fast Flow resin (GE Life Sciences). The resin is washed with 40 ml of this low-salt buffer, and the protein eluted with 5 ml of activity buffer containing 50 mM tris(hydroxymethyl)-aminomethane (Tris)-HCl (pH 7.0), 0.5 M NaCl, 20% glycerol, 10 mM TCEP. The eluted proteins were quantified by SDS-PAGE.
In Vitro Transcription of sgRNAs.

Linear DNA fragments containing the T7 promoter followed by the sgRNA target sequence are transcribed in vitro using primer sequences with the TranscriptAid T7 High Yield Transcription Kit (ThermoFisher Scientific) according to the manufacturer's instructions. sgRNA products are purified using the MEGAclear Kit (ThermoFisher Scientific) according to the manufacturer's instructions and are quantified by UV absorbance.

Preparation of Cy3-Conjugated dsDNA Substrates.

Typically, sequences of unlabelled strands, e.g., 80-nt in length, are ordered as PAGE-purified oligonucleotides from Integrated DNA Technologies (IDT). The labelled primer is complementary to the 3' end of each substrate, e.g., 80-nt substrate. The primer was ordered as an HPLC-purified oligonucleotide from IDT. To generate the Cy3-labelled dsDNA substrates, the 80-nt strands (5 µl of a 100 µM solution) were combined with the Cy3-labelled primer (5 µl of a 100 µM solution) in NEBuffer 2 (38.25 µl of a 50 mM NaCl, 10 mM Tris-HCl, 10 mM MgCl2, 1 mM DTT, pH 7.9 solution, New England Biolabs) with dNTPs (0.75 µl of a 100 mM solution) and heated to 95° C. for 5 min, followed by a gradual cooling to 45° C. at a rate of 0.1° C. per s. After this annealing period, Klenow exo-(5 U, New England Biolabs) was added and the reaction was incubated at 37° C. for 1 hour. The solution was diluted with buffer PB (250 µl, Qiagen) and isopropanol (50 µl) and purified on a QIAprep spin column (Qiagen), eluting with 50 µl of Tris buffer. Deaminase assay on dsDNA. The purified fusion protein (20 µl of 1.9 µM in activity buffer) was combined with 1 equivalent of appropriate sgRNA and incubated at ambient temperature for 5 minutes. The Cy3-labelled dsDNA substrate was added to final concentration of 125 nM and the resulting solution was incubated at 37° C. for 2 hours. The dsDNA was separated from the fusion by the addition of buffer PB (100 µl, Qiagen) and isopropanol (25 µl) and purified on a EconoSpin micro spin column (Epoch Life Science), eluting with 20 µl of CutSmart buffer (New England Biolabs). USER enzyme (1 U, New England Biolabs) was added to the purified, edited dsDNA and incubated at 37° C. for 1 hour. The Cy3-labeled strand was fully denatured from its complement by combining 5 µl of the reaction solution with 15 µl of a DMSO-based loading buffer (5 mM Tris, 0.5 mM EDTA, 12.5% glycerol, 0.02% bromophenol blue, 0.02% xylene cyan, 80% DMSO). The full-length C-containing substrate was separated from any cleaved, U-containing edited substrates on a 10% TBE-urea gel (Bio-Rad) and imaged on a GE Amersham Typhoon imager.

Preparation of In Vitro-Edited dsDNA for High-Throughput Sequencing.

The oligonucleotides are obtained from Integrated DNA Technologies (IDT). Complementary sequences are combined (5 µl of a 100 µM solution) in Tris buffer and annealed by heating to 95° C. for 5 minutes, followed by a gradual cooling to 45° C. at a rate of 0.1° C. per s to generate 60-bp dsDNA substrates. Purified fusion protein or fusion proteins (20 µl of 1.9 µM in activity buffer) is combined with 1 equivalent of appropriate sgRNA pairs and incubated at ambient temperature for 5 min. The 60-mer dsDNA substrate is added to final concentration of 125 nM, and the resulting solution is incubated at 37° C. for 2 h. The dsDNA is separated from the fusion by the addition of buffer PB (100 µl, Qiagen) and isopropanol (25 µl) and purified on a EconoSpin micro spin column (Epoch Life Science), eluting with 20 µl of Tris buffer. The resulting edited DNA (1 µl was used as a template) is amplified by PCR using the high-throughput sequencing primer pairs and VeraSeq Ultra (Enzymatics) according to the manufacturer's instructions with 13 cycles of amplification. PCR reaction products are purified using RapidTips (Diffinity Genomics), and the purified DNA is amplified by PCR with primers containing sequencing adapters, purified, and sequenced on a MiSeq high-throughput DNA sequencer (Illumina) as previously described.

Cell Culture.

HEK293T (ATCC CRL-3216), U2OS (ATCC HTB-96), CD34+ cells, ARPE-19 cells or other relevant cell types are maintained in Dulbecco's Modified Eagle's Medium plus GlutaMax (ThermoFisher) supplemented with 10% (v/v) fetal bovine serum (FBS), at 37° C. with 5% CO2. HCC1954 cells (ATCC CRL-2338) are maintained in RPMI-1640 medium (ThermoFisher Scientific) supplemented as described above. Immortalized cells containing a gene containing the target sequence (Taconic Biosciences) are cultured in Dulbecco's Modified Eagle's Medium plus GlutaMax (ThermoFisher Scientific) supplemented with 10% (v/v) fetal bovine serum (FBS) and 200 µg ml-1 Geneticin (ThermoFisher Scientific).

Transfections.

HEK293T (or other host cells) are seeded on 48-well collagen-coated BioCoat plates (Corning) and transfected at approximately 85% confluency. Briefly, 750 ng of BE and 250 ng of sgRNA expression plasmids are transfected using 1.5 µl of Lipofectamine 2000 (ThermoFisher Scientific) per well according to the manufacturer's protocol. HEK293T cells is transfected using appropriate Amaxa Nucleofector II programs according to manufacturer's instructions (V kits using program Q-001 for HEK293T cells).

For deaminase-dCas9 and nCas9 or nCas9-UGI fusion proteins expressed in trans, two plasmids encoding deaminase-dCas9 and nCas9 or nCas9-UGI proteins are transfected in equimolar ratios ($9.05 \times 10^{-14}$ mol of each half; 863 ng total editor DNA). With regard to the guide, 127 ng of guide plasmid ($9.05 \times 10^{-14}$ mol) is used in each transfection. 490 ng ($9.05 \times 10^{-14}$ mol) of pCMV-ABE7.10 with bipartite NLS (C-terminal) and GeneArt codon optimization or pCMV-BE3 with bipartite NLS and GeneArt copdon optimization+pNMG-B8 (a non-relevant plasmid that does not express in mammalian cells used to normalize amount of DNA transfected) are used as controls.

High-Throughput DNA Sequencing of Genomic DNA Samples

Transfected cells are harvested after 3 days and the genomic DNA is isolated using the Agencourt DNAdvance Genomic DNA Isolation Kit (Beckman Coulter) according to the manufacturer's instructions. On-target and off-target genomic regions of interest are amplified by PCR with flanking high-throughput sequencing primer pair. PCR amplification is carried out with Phusion high-fidelity DNA polymerase (ThermoFisher) according to the manufacturer's instructions using 5 ng of genomic DNA as a template. Cycle numbers are determined separately for each primer pair as to ensure the reaction is stopped in the linear range of amplification. PCR products are purified using RapidTips (Diffinity Genomics). Purified DNA is amplified by PCR with primers containing sequencing adaptors. The products are gel purified and quantified using the Quant-iT PicoGreen dsDNA Assay Kit (ThermoFisher) and KAPA Library Quantification Kit-Illumina (KAPA Biosystems). Samples are sequenced on an Illumina MiSeq as previously described (Pattanayak, Nature Biotechnol. 31, 839-843 (2013)).

Data Analysis.

Sequencing reads are automatically demultiplexed using MiSeq Reporter (Illumina), and individual FASTQ files are analysed with a custom Matlab. Each read is pairwise aligned to the appropriate reference sequence using the Smith-Waterman algorithm. Base calls with a Q-score below 31 are replaced with Ns and were thus excluded in calculating nucleotide frequencies. This treatment yields an expected MiSeq base-calling error rate of approximately 1 in 1,000. Aligned sequences in which the read and reference sequence contained no gaps are stored in an alignment table from which base frequencies could be tabulated for each locus. Indel frequencies are quantified with a custom Matlab script using previously described criteria (Zuris, et al., *Nature Biotechnol.* 33, 73-80 (2015). Sequencing reads are scanned for exact matches to two 10-bp sequences that flank both sides of a window in which indels might occur. If no exact matches are located, the read is excluded from analysis. If the length of this indel window exactly matched the reference sequence the read is classified as not containing an indel. If the indel window is two or more bases longer or shorter than the reference sequence, then the sequencing read is classified as an insertion or deletion, respectively.

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All patents and publications mentioned in this specification are herein incorporated by reference to the same extent as if each independent patent and publication was specifically and individually indicated to be incorporated by reference.

SEQUENCE LISTING (144 sequences)

SEQ ID NO: 1 - protein, 167 aa, Escherichia coli
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 2 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 3 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 4 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 5 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 6 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 7 - protein, 171 aa, Haemophilus influenzae
MDAAKVRSEFDEKMMRYALELADKAEALGEIPVGAVLVDDARNIIGEGWNLSIVQSDPTAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 8 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 9 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 10 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 11 - protein, 1410 aa, Artificial Sequence
  Description of Artificial Sequence: Synthetic polypeptide
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 12 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 13 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 14 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 15 - protein, 1368 aa, Streptococcus pyogenes [sequence omitted]

SEQ ID NO: 16 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 17 - protein, 1368 aa, Artificial Sequence [sequence omitted]

SEQ ID NO: 18 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 19 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 20 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 21 - protein, 1367 aa, Artificial Sequence
  Description of Artificial Sequence: Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 22 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 23 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 24 - protein, 1210 aa, Unknown
  Description of Unknown: uncultured Parcubacteria group bacterium sequence
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 25 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 26 - DNA, 766 bp, Petromyzon marinus
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 27 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 28 - DNA, 10681 bp, Homo sapiens
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 29 - protein, 198 aa, Homo sapiens [sequence omitted]

SEQ ID NO: 30 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 31 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 32 - protein, 199 aa, Bos sp.
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 33 - protein, 239 aa, Rattus norvegicus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 34 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 35 - protein, 430 aa, Rattus norvegicus
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 36 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 37 - protein, 384 aa, Pan sp.
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 38 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 39 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 40 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 41 - protein, 382 aa, Rattus sp.
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 42 - protein, 395 aa, Rattus norvegicus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 43 - protein, 226 aa, Bos sp.
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 44 - protein, 490 aa, Pan sp.
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 45 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 46 - protein, 190 aa, Gorilla sp.
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 47 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 48 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 49 - protein, 185 aa, Bos sp.
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 50 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 51 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 52 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 53 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 54 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 55 - protein, 229 aa, Rattus norvegicus [sequence omitted]

SEQ ID NO: 56 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 57 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 58 - protein, 224 aa, Rattus norvegicus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 59 - protein, 224 aa, Bos sp.
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 60 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 61 - protein, 381 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 62 - protein, 182 aa, Homo sapiens
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 63 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 64 - protein, 16 aa, Artificial Sequence
  Description of Artificial Sequence: Synthetic peptide
SGSETPGTSESATPES

SEQ ID NO: 65 - protein, 4 aa, Artificial Sequence
  Description of Artificial Sequence: Synthetic peptide
SGGS

SEQ ID NO: 66 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 67 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 68 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 69 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 70 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 71 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 72 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  MISC_FEATURE (1)..(60): This sequence may encompass 1-30 "Xaa Pro" repeating units, wherein Xaa is any amino acid
XPXPXPXPXPXPXPXPXPXPXPXPXPXPXPXPXPXPXPXPXPXPXPXPXPXPXPXPXPXP

SEQ ID NO: 73 - protein, 24 aa, Artificial Sequence
  Description of Artificial Sequence: Synthetic peptide
SGGSSGSETPGTSESATPESSGGS

SEQ ID NO: 74 - protein, 32 aa, Artificial Sequence
  Description of Artificial Sequence: Synthetic polypeptide
SGGSSGGSSGSETPGTSESATPESSGGSSGGS

SEQ ID NO: 75 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 76 - protein, 24 aa, Artificial Sequence
  Description of Artificial Sequence: Synthetic peptide
SGGSSGGSSGSETPGTSESATPES

SEQ ID NO: 77 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 78 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 79 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 80 - protein, 18 aa, Artificial Sequence
  Description of Artificial Sequence: Synthetic peptide
KRTADGSEFESPKKKRKV

SEQ ID NO: 81 - protein, 16 aa, Artificial Sequence
  Description of Artificial Sequence: Synthetic peptide
KRPAATKKAGQAKKKK

SEQ ID NO: 82 - protein, 17 aa, Artificial Sequence
  Description of Artificial Sequence: Synthetic peptide
KKTELQTTNAENKTKKL

SEQ ID NO: 83 - protein, 19 aa, Artificial Sequence
  Description of Artificial Sequence: Synthetic peptide
KRGINDRNFWRGENGRKTR

SEQ ID NO: 84 - protein, 16 aa, Artificial Sequence
  Description of Artificial Sequence: Synthetic peptide
RKSGKIAAIVVKRPRK

SEQ ID NO: 85 - protein, 7 aa, Artificial Sequence
  Description of Artificial Sequence: Synthetic peptide
PKKKRKV

SEQ ID NO: 86 - protein, 30 aa, Artificial Sequence
  Description of Artificial Sequence: Synthetic polypeptide
MDSLLMNRRKFLYQFKNVRWAKGRRETYLC

SEQ ID NO: 87 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 88 - protein, 166 aa, Escherichia coli
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 89 - protein, 166 aa, Artificial Sequence
  Description of Artificial Sequence: Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 90 - protein, 1368 aa, Artificial Sequence; identical to SEQ ID NO: 18
  Description of Artificial Sequence: Synthetic polypeptide

SEQ ID NO: 91 - protein, 1052 aa, Artificial Sequence
  Description of Artificial Sequence: Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 92 - protein, 1052 aa, Artificial Sequence
  Description of Artificial Sequence: Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 93 - protein, 1052 aa, Artificial Sequence
  Description of Artificial Sequence: Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 94 - protein, 1367 aa, Artificial Sequence; identical to SEQ ID NO: 21
  Description of Artificial Sequence: Synthetic polypeptide

SEQ ID NO: 95 - protein, 1367 aa, Artificial Sequence; identical to SEQ ID NO: 20
  Description of Artificial Sequence: Synthetic polypeptide

SEQ ID NO: 96 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 97 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 98 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 99 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 100 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 101 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 102 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 103 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 104 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 105 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 106 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 107 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 108 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 109 - protein, 1140 aa, Bacillus hisashii
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 110 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 111 - protein, 1368 aa, Artificial Sequence [sequence omitted]

SEQ ID NO: 112 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 113 - protein, 1367 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 114 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 115 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 116 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 117 - protein, 29 aa, Artificial Sequence
  Description of Artificial Sequence: Synthetic peptide
PKKKRKVEGADKRTADGSEFESPKKKRKV

SEQ ID NO: 118 - protein, 18 aa, Artificial Sequence
  Description of Artificial Sequence: Synthetic peptide
KRTADGSEFESPKKKRKV

SEQ ID NO: 119 - protein, 16 aa, Artificial Sequence
  Description of Artificial Sequence: Synthetic peptide
KRPAATKKAGQAKKKK

SEQ ID NO: 120 - protein, 17 aa, Artificial Sequence
  Description of Artificial Sequence: Synthetic peptide
KKTELQTTNAENKTKKL

SEQ ID NO: 121 - protein, 19 aa, Artificial Sequence
  Description of Artificial Sequence: Synthetic peptide
KRGINDRNFWRGENGRKTR

SEQ ID NO: 122 - protein, 23 aa, Artificial Sequence
  Description of Artificial Sequence: Synthetic peptide
RKSGKIAAIVVKRPRKPKKKRKV

SEQ ID NO: 123 - protein, 30 aa, Artificial Sequence; identical to SEQ ID NO: 86
  Description of Artificial Sequence: Synthetic polypeptide

SEQ ID NO: 124 - protein, 16 aa, Artificial Sequence
  Description of Artificial Sequence: Synthetic peptide
KRPAATKKAGQAKKKK

SEQ ID NO: 125 - protein, 4 aa, Artificial Sequence
  Description of Artificial Sequence: Synthetic peptide
GGGS

SEQ ID NO: 126 - protein, 5 aa, Artificial Sequence
  Description of Artificial Sequence: Synthetic peptide
GGGGS

SEQ ID NO: 127 - protein, 5 aa, Artificial Sequence
  Description of Artificial Sequence: Synthetic peptide
EAAAK

SEQ ID NO: 128 - protein, 4 aa, Artificial Sequence
  Description of Artificial Sequence: Synthetic peptide
SGGS

SEQ ID NO: 129 - protein, 21 aa, Artificial Sequence
  Description of Artificial Sequence: Synthetic peptide
  MISC_FEATURE (1)..(21): This sequence may encompass 1, 3 or 7 "Gly Gly Ser" repeating units
GGSGGSGGSGGSGGSGGSGGS

SEQ ID NO: 130 - protein, 2797 aa, Artificial Sequence
  Description of Artificial Sequence: Synthetic polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGMTNLSDIIEKETGKQLVIQESILMLPEEVEEVIGNKPESDILVHTAYDESTDENVMLLTSDAPEYKPWALVIQDSNGENKIKMLEGADKRTADGSEFESPKKKRKV

SEQ ID NO: 131 - protein, 2797 aa, Artificial Sequence
  Description of Artificial Sequence: Synthetic polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGMTNLSDIIEKETGKQLVIQESILMLPEEVEEVIGNKPESDILVHTAYDESTDENVMLLTSDAPEYKPWALVIQDSNGENKIKMLEGADKRTADGSEFESPKKKRKV

SEQ ID NO: 132 - protein, 1713 aa, Artificial Sequence
  Description of Artificial Sequence: Synthetic polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDMTNLSDIIEKETGKQLVIQESILMLPEEVEEVIGNKPESDILVHTAYDESTDENVMLLTSDAPEYKPWALVIQDSNGENKIKMLEGADKRTADGSEFESPKKKRKV

SEQ ID NO: 133 - protein, 1074 aa, Artificial Sequence
  Description of Artificial Sequence: Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGEGADKRTADGSEFESPKKKRKV

SEQ ID NO: 134 - protein, 1074 aa, Artificial Sequence
  Description of Artificial Sequence: Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKV

SEQ ID NO: 135 - protein, 1074 aa, Artificial Sequence
  Description of Artificial Sequence: Synthetic polypeptide
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKV

SEQ ID NO: 136 - protein, 2829 aa, Artificial Sequence
  Description of Artificial Sequence: Synthetic polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGGSSGGSSGSETPGTSESATPESSGGSSGGSKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSSGGSSGSETPGTSESATPESSGGSSGGSMTNLSDIIEKETGKQLVIQESILMLPEEVEEVIGNKPESDILVHTAYDESTDENVMLLTSDAPEYKPWALVIQDSNGENKIKMLSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 137 - protein, 2829 aa, Artificial Sequence
  Description of Artificial Sequence: Synthetic polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGGSSGGSSGSETPGTSESATPESSGGSSGGSKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGSGGSSGGSSGSETPGTSESATPESSGGSSGGSMTNLSDIIEKETGKQLVIQESILMLPEEVEEVIGNKPESDILVHTAYDESTDENVMLLTSDAPEYKPWALVIQDSNGENKIKMLSGGSSGGSSGSETPGTSESATPESSGGSSGGSDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 138 - protein, 2331 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQSGGSSGGSSGSETPGTSESATPESSGGSSGGSKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGEGADKRTADGSEFESPKKKRKV

SEQ ID NO: 139 - protein, 2331 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQSGGSSGGSSGSETPGTSESATPESSGGSSGGSKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKV

SEQ ID NO: 140 - protein, 1247 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 141 - protein, 2529 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQSGGSSGGSSGSETPGTSESATPESSGGSSGGSKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGEGADKRTADGSEFESPKKKRKV

SEQ ID NO: 142 - protein, 2529 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQSGGSSGGSSGSETPGTSESATPESSGGSSGGSKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKGEGADKRTADGSEFESPKKKRKV

SEQ ID NO: 143 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 144 - RNA, 90 nt, Artificial Sequence
  Description of Artificial Sequence: Synthetic oligonucleotide
guuuuaguacucuguaaugaaaauuacagaaucuacuaaaacaaggcaaaaugccguguuuaucucgucaacuuguuggcgagauuuuuu

What is claimed is:

1. A nucleobase editor system comprising
   (a) a first nucleic acid programmable DNA binding protein (napDNAbp) domain that lacks nuclease activity and has nucleic acid sequence specific binding activity,
   (b) a second napDNAbp domain that has nickase activity and nucleic acid sequence specific binding activity, and
   (c) an adenosine deaminase domain having base editing activity and comprising an amino acid sequence having at least 95% identity to the following amino acid sequence:

(SEQ ID NO: 89)
   SEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRI

GRVVFGVRNAKTGAAGSLMDVLHYPGMNHRVEITEGILADECAALLCYF

FRMPRQVFNAQKKAQSSTD, wherein the first napDNAbp domain is complexed with a first guide RNA, wherein the second napDNAbp domain is complexed with a second guide RNA,
   wherein the first napDNAbp and the second napDNAbp are each derived from different species, and
   wherein the first guide RNA and the second guide RNA are different.

2. A nucleobase editor system comprising one or more polynucleotides encoding (a), (b), (c), and the first and second guide RNAs of claim 1.

3. A kit comprising the nucleobase editor of claim 1.

4. The nucleobase editor system of claim 1, wherein the first napDNAbp domain is a catalytically inactive CRISPR-Cas (dCas), and/or wherein the second napDNAbp domain is a CRISPR-Cas nickase (nCas).

5. The nucleobase editor system of claim 1, wherein the first or the second napDNAbp is fused to a Uracil DNA glycosylase inhibitor (UGI) domain.

6. The nucleobase editor system of claim 1, wherein the first or the second napDNAbp is fused with one or more Nuclear Localization Signals (NLS).

7. The nucleobase editor system of claim 6, wherein the NLS is a bipartite NLS.

8. The nucleobase editor system of claim 1, wherein the first napDNAbp is a dCas and wherein the second napDNAbp is a nCas, and wherein the dCas domain binds a canonical PAM sequence and the nCas domain binds a non-canonical PAM sequence.

9. The nucleobase editor system of claim 1, wherein the first napDNAbp is a dCas and wherein the second napDNAbp is a nCas, and wherein the nCas domain and the dCas domain have different PAM specificities.

10. The nucleobase editor system of claim 8, wherein the nCas binds a non-canonical PAM sequence selected from the group consisting of NGG, NGA, NGCG, NGC, NGN, NGT, NNGRRT, NNNRRT, NGCG, NGCN, NGTN, NGTN, NGTN, and NAA.

11. The nucleobase editor system of claim 9, wherein the dCas is derived from an *S. pyogenes* Cas9 and binds a PAM sequence selected from the group consisting of NGA, NGCG, NGC, NGN, NGT, NNGRRT, NNNRRT, NGCG, NGCN, NGTN, NGTN, NGTN, and NAA.

12. The nucleobase editor system of claim 1, wherein the first and the second napDNAbp are selected from the group consisting of Cas12a, Cas12b, Cas12c, Cas12d, Cas12e, Cas12g, Cas12h, and Cas12i.

13. The nucleobase editor system of claim 1, wherein the first napDNAbp comprises a gRNA binding domain of Cas9.

14. The nucleobase editor system of claim 13, wherein the first napDNAbp is a dCas9 domain incapable of cleaving a target nucleic acid sequence or the reverse complement strand of the target nucleic acid sequence.

15. The nucleobase editor system of claim 1, wherein the first or second napDNAbp domain is derived from Cas12a, Cas12b, Cas12c, Cas12d, Cas12e, Cas12g, Cas12h, or Cas12i.

16. The nucleobase editor system of claim 1, wherein the first napDNAbp domain is a dCas9 of *S. pyogenes* (dSpCas9), wherein the second napDNAbp domain is a nCas9 of *S. aureus* (nSaCas9), wherein the dSpCas9 and the nSaCas9 are joined by a linker, and wherein the domain having base editing activity is immediately adjacent to the first napDNAbp domain.

17. A nucleobase editor system comprising
  (a) a first nucleic acid programmable DNA binding protein (napDNAbp) domain that lacks nuclease activity and has nucleic acid sequence specific binding activity,
  (b) a second napDNAbp domain that has nickase activity and nucleic acid sequence specific binding activity, and
  (c) an adenosine deaminase domain having base editing activity and comprising the following amino acid sequence:

(SEQ ID NO: 89)
SEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRI

GRVVFGVRNAKTGAAGSLMDVLHYPGMNHRVEITEGILADECAALLCYF

FRMPRQVFNAQKKAQSSTD, wherein the first napDNAbp domain is complexed with a first guide RNA, wherein the second napDNAbp domain is complexed with a second guide RNA,
  wherein the first napDNAbp and the second napDNAbp are each derived from different species, and
  wherein the first guide RNA and the second guide RNA are different.

* * * * *